United States Patent 12,642,819 (COMPOSITIONS AND METHODS FOR TREATING INFLAMMATORY BOWEL DISEASE) - sequence listing, part 73

SEQ ID NO: 35 - DNA, 3261962 bp, Clostridium sp. (residues 1,630,982-3,261,962 of 3,261,962)
  modified_base (42250)..(42270): a, c, t, g, unknown or other
  modified_base (118168)..(118176): a, c, t, g, unknown or other
  modified_base (221594)..(221603): a, c, t, g, unknown or other
  modified_base (267738)..(267747): a, c, t, g, unknown or other
  modified_base (628530)..(628629): a, c, t, g, unknown or other
  modified_base (967855)..(967953): a, c, t, g, unknown or other
  modified_base (996929)..(996937): a, c, t, g, unknown or other
  modified_base (1226070)..(1226079): a, c, t, g, unknown or other
  modified_base (1263112)..(1263128): a, c, t, g, unknown or other
  modified_base (1356254)..(1356263): a, c, t, g, unknown or other
  modified_base (1364685)..(1364694): a, c, t, g, unknown or other
  modified_base (1500511)..(1500519): a, c, t, g, unknown or other
  modified_base (1667726)..(1667735): a, c, t, g, unknown or other
  modified_base (1766818)..(1766825): a, c, t, g, unknown or other
  modified_base (1944520)..(1944617): a, c, t, g, unknown or other
  modified_base (2165039)..(2165138): a, c, t, g, unknown or other
  modified_base (2707294)..(2707393): a, c, t, g, unknown or other
  modified_base (2860367)..(2860462): a, c, t, g, unknown or other
  modified_base (2997917)..(2997926): a, c, t, g, unknown or other
  modified_base (3161771)..(3161780): a, c, t, g, unknown or other
  modified_base (3207121)..(3207245): a, c, t, g, unknown or other
attgtttatccaacggattgttattttccaacatgggtaattccagaagaagcacctgtaacaaaagctgtagtaaaggcttttgaaggattgtatggaactccgaagattgataaatggacattttcaactaatggagtatctataatgggtagatttggtataccttgtattggatttgggccaggaaaggaggaagaagcacatgctcctaatgaaaaaacttggaaagctgatttagttaaatgtgcagcagtttatgcggcaataccaactatttattgtaataacaaataataaggagatattggaaatggaattgatggaaacatttattaataaattaaatgaattaaattttaaagagatgtataataacgattttctgttaacatgggaaaaaactgatgatgagataaaggctgttttcatagttgcagaagctttaaaaaggttaagagaaaataatatatctcctaagatttttgatagtggattaggagtttcactttttagggataattcaactaggacaagatttagttttgcttctgcctgtaatttactaggacttaaagtacaagatttagatgaaggaaaatcacaaattgctcatggtgaaacagtaagagaaactgctaatatgatctctttcatggctgatgtaataggaattcgtgatgatatgtatataggtaaaggaaatacttatatgaggactgtatcagaagcggttagggagggttataaaagtgggtgcctagagcaaataccaactttagttaatcttcaatgtgatatagaccatccaacacaagttatggcagatactcttcatttaattaatgaatttggaggagtagagaatttaaaaggtaaaaaggttgctatgacatgggcatattcaccatcatatggtaagcctttatcagtaccacaaggggtaattggtttaatgactagatttgggatgaatgtagtattagcacatccagaaggatatgaagtaatgagtagtgttgaagaaatagcttataaaaatgctaaggcttcaggtggatcatttacaaaaactaattctatgaaggaagcatttaaagatgcagatatagtttatccaaaaagctgggcaccttatatagcaatggaaaagcgtacagatttatatgaaagaggtgatagtaatggaataaatgaactagaaaaagaattattatctcaaaatgcaaaacataaggattggcaatgtactgaggaattaatgaagactactaagaatggaaaagccatttatcttcattgtttaccagctgatattagtggagtaagttgtgaaagtggtgaggtcgaagcttcagtatttgatagatataggaattcattatataaagaagcaagttataaaccttatattattgcttctatgatttttttaagtaagataaaaaatccgcaagaagcattaagaattttagagagaagcggaatagaaagatatttgaaataaaaatatcttttactatagaaaatattaattagcagaatagatatatatatattttatggatagtaaaggtgtgaatataatgaagaaaaggatagttattgcgctaggtggaaatgcattaggtgatacattagaagagcaaatgatagcagtaaaatcaacagctaaggcaatagttgacttaattgaagaaggggatgaggtaattatatctcatggaaatggtcctcaagttgggatgattaatagtgcaatgactgaatttcataaaacaaatacaaagtattctatatgtccaatgtcagtgtgcgtagcaatgagccaaggatatataggatatgatttacagaatgcaataagggaagagttattaaatagaaatataaataaaggtgtagcaactataattactcaagttgaggttgatgaaggagacaaagcatttgaaaatccaactaagccaataggagcttttatgactaaaaaagaagcagatagcattgtaaaagagggtaagaagattatagaggatagtggtagaggatatagaagagttatagcatcacctaagcctattggaatagtagaagttgaaacgataaaagcgctaatagaaaataatcaagttgtaatagcgtgtggaggtggaggtattcctgtaatttctaaaggcaatcatttaaaaggggttggagctgtagttgataaagattatgcaagtgcggttttagcaaaagaaattaatgctgattgtctagttattctaacagcagtagaaaaagttgcaataaattttggaaaaaagaatgagcaatggttaaatgaagtaaatgttaatgaaatgaagttatttcttaagaaagggtattttgctccagggtctatgaagcctaaagtagaggctgcaatagaatttgtagaatcaagaaaagatagatattcaataattactttattggaaaaggctaaagaaggaattttaggtaaaacaggaactagaattgttaattttagtacaaaagtaaaagttgattaatagaagtgtaaagaaattatgataagtatgggaaataactgaaaaataaagtggagtatgtaaagaaggtgggtataggtatgattttaattggaaatggaagggttattacgaatgatgaaaatgaaagaattatagaaaatggatgtattgttattgatgggaatacaattaaagaggttggtgatacatcattaattaaatgtaagtatgaagataatgaatatgagtatatagatgcagagggtaagattattatgccgggtatgataaatactcaccatcatatatatagtgaatttgcaagaggattagactttaaaaatggcaagctacagtcatttactgatatattgaaaaatatttggtggaagattgataagaagttaacattggaggatttaagatacagtgcatatacagcatttattgaatgtattaaaaatggagttacaacagtttttgatcataattcaagccctatgagtataagtggaagtttacttacgatttctaatgttgcagatgaattaggcattagaggatgttattgttatgaagtttcagatagagatggaaatagagctttagatcttgccattaaagaaaatattgattttataaagtatgcagaaaagaaacaagatgatatgactaaaggcatgtttggaatgcatgcggcttttacattaagtgatggaactttaaataaatgtgttaaggccatggaaggtattgatacagggtatcacattcatgttgcagaaggaaaagaagacttagaaaatagtttgaaattatataaaaagagaatagtaaaaagattaaatgattttggtatattaggagaaaagactattgcagcccattgtttatatatagatgatgaagaattagatatattgaaagatactaaaactatagttgttaacaatccagagtctaatatggctaatggagtaggtgttgcagccattaatagtatgttagataaggatatagtattaggaattggaactgatggatatacaagtgatatttttgagtcaatgaaggtagaaaatcttattaacaaataccattttggtgattataatattggatttatggaaactaaacaaatggcattaaaaaataatattaaaattgcttcaagattttttgagaaaccactaggggtattaaagaaaggatcatatgcagatctaatcattgtagattataagccatttactcctatgaataagaataattattttgcacacgtattgttcggaatttcaggaaaatctgttgatacaactataattaatggaaaagttgttatgaaagataggaagatagttactattgatgaggaaaagatttgtagagaatcaatcaatattgcagaaaagctttggaagaggatataggagaaaaataatggaggtagtgatatgcagagctaagcatgtatatattatgcttgagacttgctaatggaataaaaatatggttagtttttttctaaatggtcaacttaagtggataagtgaagaagaaaagttaataaagtatttaagagaaaaagagaacttagtttctgtaaaaaatggatgtaatgaaggggcttgtggtgcatgcatggttctaattgatggtaaggcaacaaaatcatgcattgtaaaggggaagaaacttcaaggaaaaaatgtaataacgatagaaggattaagtcagaagtataggaaagtatttgcatatgcttttactaaagtgggagctgttcagtgtggattttgtataccaggaatggttataagtgcagtaggattattgaataaaacgttaaatccctcattaaatgatgtgaagaaggcacttgttggaaatatatgcagatgtacaggatataaaaaaattgaagaagcaatattaatggctgcggaaataataagagagaataaagaaattccattaactaaatgtaaaggactaataggggatccgttgggaagagtagatgctgaaaataaggtattagcattagatggatactgtgatgatttaaaggttgagggaatgttatatggggtagcgcttaggcctaagtatcctagaattctaataaaaaatattgattatagcgaggctttacagataaaaggagtagttgaagtagtaacagctaaagatataccaggaaatagattttgtgggcatttaaaaaaagattggccagcattaattgatataggtgaggaaactagatatattggtgatgcaatagcgttaattgcagctgaaagcgaggagattgcaagaaaagcaatggggttgattaaagttaattttgaaaaattgaaaccaataacttcgcctaatgaagctttagaaaaagatgctccaaaacttcatagtgacggtaatgttttagcaagagagattttgaaaagaggaaatgtagatgaagcattaaaaaaatctaaatttattgttaataataaatattctgtcccttttactgagcatgcttttttagaaccggaatcagcacttgctatacctacagatagagaattaatggtttatacagggactcaatctgtttatgatgatttaagagaaatttcatctttgttaggagtggatatagataaaattagagttgtttcaaagtatgttggaggcggttttggtggtaaggaggatatgagttgtcaacatcatacagcacttcttgcttatttaaccggaaaaccagtaaaaatgactttaactagggctgaaagtattaatgttcatcctaagagacatgctatggaaatggaatttactacagcttgtgatgaaaatggaatattaacagccatgaaagcaaagataattgcagatactggagcttatgcatctttaggaggaccagtgttacaaagagcgtgtactcatgctgcaggaccatataattatcaaaattcagaagttgaaggaattgcagtatatactaataatccaccatcaggtgcgtttagaggatttggagttactgaatcagcatttgcaattgaatctaatataaataagcttgcggaattagttggtatatctccgtgggaaataagatggagaaatgcaatagaagcgggtcaggaactacctaatgggcaaatagcagataatgatactgcatttaaagatactttacttgctgttaaagatgaatattataaaagtgaatttgctggaatagcttgtgcatttaaaaattccggaataggtgtagggttacctgatataggaagaacgcttttagaagtacaaaatggaaaaataatcataagaacgtctgcagcttgtatgggacaaggagtaggaacaacaatgactcaaattgtttgtgaggtattaaatatagatgcaaatagtgtagtttggatacagccggatacgaaaaggactcctgacgcaggaacatcaacagcttcaagacagactttatttacaggagaagctactagaatagcagcattaaagttaaaggcagctattaaaggaaataacttaaattcagttaatggacaagaattttatggtgagtattatggtaaaactgataaaatgggaagtgaaaaaaataatcctataagtcatgttgcttatggatatgcaacacaagttgtaattttaaataaagatggaagtttgaaaaaagttattgcagctcatgatgttggaaaagcaattaaccctttgaatgttgaagggcagattgaaggaggagttgttatgggacttggatatgcattaactgaagattatccattaaaggatagtattccaactgcaaagtttggaactttagggttgttcagatcaactatggttcctgaaatagtaccaattattgttgagaagagtaattcgaaattagcttatggagcaaaaggggttggcgaaattacttgtattccaacagctcctgcagttcaaaatgcatattataaattggatggaatctttagaactaagttaccgctaaaaaacaccttttatagaaaataggagtgtttaagataaaattatactttgaaggaaatatgtttaaaaagtaaagaagtgtgttataattatatttgatttaataggcaaaactaaagaaatttagtgacgcaaagctataggaactaaggggaatctaagtcagccagttgccaaagagtaagatatactttttgtttataaggtgatttgtttaatgattttatgattttttagctgctcttttgagtagctttttttatattaaaaatgtaaaagataagttataaaagcacggagttctgtaaaataattatttaataatatggtaagaggggagtagtaaactatgttatacagagtaataatctagaaggaaactaaagattattccataggaaaatcatatagtaataaaaaataaatagtgaggcatacgatatttagaaaagatattgtatgtcttttttatataaataatataaaaggaaaaaatataatctacttatagtaatatgtttgtatttttagagtaatatatgttaaataaatatatatagtatatattaaatatacaatttaatatataaatgaggtaattatgaaaagaacattatacgactataaagaaaaaataaaaaaactacctataaaagataaatatatcaaaggtgaaatattaattgaggattttcttattgataaggagaataatatagaaatatattatgcaccacataatgaatatttaaatccaaaagcaaaggtatttattattggaataactccaggatttcaacaaatgagcactgctatagcaacagcaagaaaagaattagaagtaagtgataacattgaagaaatacaatataaatgtaaggttgcagctagatttagtggaagtttaagaaaaaatattatttcgatgttagatggaatagagcttaacaatatattaaatttacaaagctgtagtcaattattcgatgaagatgattatttattacatacaatatctttaataccgtatcctgtttttgttaagggagaaaattacactggacatacacctaaattaattaaaagcaaatttttgatgaaatatatttatgataattttataaatgagtttaagaaattagagaaatcagaagaaatattattaatacctttaggaaaagctgttgaagaggtgttaataaagttaaaagaggatggcattataaaagaagaacaaattcttatgggatttccacatccttcaggagcgaatgttaatagggtaactcaatttgaagctaataaagataatatgattaagtttattaagaagcatttttaatatatgtagaaggcaatattaatatttatacctaaggataaaatgaaggatttaggatatgaggattatttagataaaatataatttaaaaggataaataaaactgcccattatataaataaagagcaggtttatttatattaattcaagtattaaacattattttttacatgaattatttgaccattttttatataagctctaggaactctattttttaacaggcaaagaacttcgtaatttatactatccatacattttgcaagatcgtcagcattaaatttaataccattgctttcacctagtaatataacctcatctccagctttaacctcatctatatcagtaacatcgatcataaattgatccatacaaatgttacctactataggagcaggtttaccattaacaataactttagcttcgtgttttaatgttctaatatatccatctgcatatccaataggaatagttgcaattttactttttctagatgttttaaaagttctattataactaatgtacattccactttctaactctttaacatgagcaattttagcttttaaagttaaagccggtttaattgataagttttcttttttaacttcatttgaaggataatatccataaagaataattccagctcttacagcatctaaataggtattaggtaaatctataattgcagcactattagatgcatgctttaaaggtatattaatttgttgtttttctagtttattaataaaatcataaatttgattaaattgatattgagtatattccttatcttcttcatcagaactagagaaatgagtaaatattccaataatgtccaaaccatctaaagagcaaatttcacaaatagacttgaaactttcatcattaggaagaaagccaattctacccataccagtatctagagcaatgtgaacttttgcctttttattaaggctttttgctaagctagataattcccttgcataatctaaatcataaattgtttgctctatatcataattaattaaatcttcacctaaatataatggtgtatatccaagtatcattataggggctgtaatgttattttttctaagttcaattgcttcagtaagcattgcaacagctagtcttgaagcgccattttctaaaaggcaaggagctacatctaaagcgccgtgtccataggcatcagcttttacaacagccataacttccttatctccagctaacttttttatatttttcatgttatttgcaaggatatctaaatctatttcagcccatacgggtctcattatcttttccataattacacctcaaatttaattatatcttactattattgtaataaaaatatataaaaatgataagtaccactaataatataatttcttatagttgtggtactataattaatattttaatatacaataatgtttccttttatttcgcgttgaattaaaacaatagtagtatataataaaaatagaaattataaaaatagtaaaaggatgaacttgtatgacaacaaaatataaaaagccagaattactagctccagcagggagtttagaaaagttgaagattgcatttcaatatggagcagatgctgtctattttggaggggaagcattttctttaagagcagcagcacaaaactttacttttgaagaaattaaagaaggggcagagcttgctcatagtttaggtaaaaaaatatactgtacagtaaatgtaatgccaagaaatgaagggatagaaaagttacctgagtttctaaaaagtcttgaagaagctaaggtggatgcagtattagtatcagatcttggagtatttagaacagtacaaaagcatactaatttgccgatacatattagtacacaggctaatacagtaaattatgaaggttgcaatatgtggcatgatttaggagcagaacgtgtagttctagctagggaatgctctttaaaggaaataaaagaaattagagaacatattccagaagaattagaattagaagtctttgtacatggagcaatgtgtatgtcatattcaggaagatgcttattatcaagttatatgacaggaagagattcaaataggggtgcatgtgcgcagagctgtagatggaaatattcattagtggaagaaaagagaccaaaccaatatttccctattgaggaagatcaacatggtacatatataatgaattcaaaagatttatgcatgatagaacatttaccagaacttttagaggcaggcatatcttcattaaagatagagggaagaaataaaagtgaatattatgttgctatagttgttaatgcatatagaaaagctatagatttatattatgaggatccagaaaactacaaattacctaaggtgttaagagatgaaatgtacaaggttagtcatagagaatataatactggattcttctttagtgaacctaaaagtgatgcaataatttatcatacaaatgaccatgttagagagtatgatgtcgttgctatagtacatgagtatgatgaagaaagtcaaattgcattatgtaagcaaagaaataaattcgtaaaaggagataaagtagaaatactaactccaggtgagtttggagaaagctttgttgttgaagaaatttataatgaagatggagaagctatagatggatgtccacatccaggaatgatgtgcaaagttaaagtaccatttaaggttggtagaaatagctttataagaaaagagttagtatagtaaaataaaatgatagtagattattaatctactatcattttatccagactgctgacaaagtgttagcagtctttaattttatacaaatatgtaatataatgttaaatatattaaattattacttctaaaaaattgaggttcaagtaacacctaaaaaatatttttaagatatattgaaataatgacttaccgattaatccaccaattctacatatcgaacaaatgattaatgaaaacatacatacacaaatgataataaatctttgctacttcactttctattttaattaattgaaatatacttatgagtatagtgatgtatagtttttaagctatagcttttaatgattcttatatataattctgcttttttaagtaatcatgtaacataataccattctggtgtacgtgattctaataagtattttttaaatttacttggtgacatttttgttgcttttttaaaaaccttactgaaatggagtgcatcctgaaatcctacgacagagactatagttgaaatattcatagttccttcttcaaggagttccttggatttttcgattcggagtttatttaaataattcattggagaactcttgaaaataatctttagttttgaaagtttgttgaccacaacagtttaccattaattgagtagtatcatcatcgtatctaataattcttcgttgatttcttaaatgtccgtagatattaatcatagcattaccatccttttatttgaaaaaataacataaaaaagcggaattgtccatattaaaaaacgttttttacatagaatttccatgttatataagtataataaaactgtaaaagaaaaatatatatttttaaattaataggagaaataaattttaaaaaataagtagttttgttaacgactgatacaacaagaaaagatatgctaggttgttatggtaatttagacatgaagactacatatctggataagctggcatatgagggtacatgatatgaaaatacatattcttgtcagctagtatgtggagtagctagaagtgttttactggaacatttccaaataccaatgggatggtatctaacagtattgtagtaggagataatgtaaaggcaattgggtagagagttaaagatgattggattgaatatgcttatattggtaaatggcatttagatagtagtgactattggggtttaggagtttgtccggaggggtggaatcaaaattattggtatgatattaaatgctatttggaggagctgacataataaagaaagagtaaaatctagaaatccagagacaatatatgaagaatggttttctgagaattttacatatgcaatcagattaaaaaaatagcaattcaatgcctgaaataatataataatttgaagctgttaaggttgatatgaaatatattgattttttgaagtgtaaataaaagtgttgagttaaaattgaataggcaaacttagggaaacttaaggacgcaaagctatagggactaaggtgtataactatgttagccagttgccaaagagtacattatactttttgttttaaagtttaattacaaatattactcattttattataagtaatatttgatttattaagtatataaaagctactctttttgagtagtttttttatgcctaattttacaatataaaataatttaaggggggtaaatatatgaataggaaaaagatatcagccttagtgttagcagcactaataacaaatttttcatctcaaacaatagaggttctagcagatgaaatttcaagaggtcaaattcctatgacagaaagtacgtctgttgagaaattgacacaagctagtataagtaaatttaacttatacaatagtaataacttaaatgcttacaatgaagcatttaaaatggacaataataatattatatccataacaaataatggaggaaactaccagcattcaactattgataaatcaattgatggagattttaatacacattgggaaacaggaaaagcaaatagctctgaatttaccaatgaagttatatttaaattaaatgaagtaacaacattaaatagaatagtatatgcagcgaggcagtcatcagctaaaggtaaaggatttgctaaggaagtagaaatatatgggtcacttacggatgaagaagatgattttagattagtgagtagtggatcatatacagggtctactggtgatatagtagaaattaaatttagtccaactgaatttaagagaataaagtttaagtttaaagtagctaatcaagattgggcttcagcatcagagtttatgttttataaagaggatttagtcagcgataaaataaagaatttattcactgacaatacaatgagtcaagtaagtgaagagtttagtaatatagaaaagataagtgagttagaagaagaagcaaaaaatcatccattatatagtgaattcaaagaggatatagaaaatgcaaagttaattgtagaaaataaagaagtcaactatattgatgctaaggtatctaaatttaaggatatgaatagtgagacacttccacagtatgatgctatatataaagttccatcaaccaatataaaatcaataactacaaatggtggtcaatatgcagataattcaatagataaagcaattgatggtgatttaaatacaaagtggcattctggaaaacaaaatagtacaacctttattaatgaagtaataattgagctaaatgaactgacgaaattaaatagaatagtatatactgctcctcgtggatctaatagagggtttgcagaacaatttgatatttatgcatcaagaacttctaagggagatacatttgaactagtatctagtggttcatctaaagtaacacaggattctatagaaataaggtttaatcctactgagtttagaagagttaaatttgtatttaaaaaaggatatgagaattgggcttgtgctgctgagtttggtttatatactcaagatgaaatagcagaaaaaatggatagattattcactgatggtacaatgagcattgtgagtgaagaatttaatacattagaaaaagtacaagcattagaggaagatgccaaaagccatccgttttatgaatattttaaagagcatttagaagatgcaaaaatgcttttacaagaaaatcaaattgaagctacaaaagcaatcacaaaacaatttaaatattattctaacgaagaatattcaaatttatttaaaatggataatgaaaatataaagagtatccgtaataatgcaggtaattatggaagtgcagtaataacaaatgctgttgacggtaatttagatacatactgggaaacaaataaatcaaatacgaatgattttacaaatgaggtagaagtagaatttaaagaagctgtggaattaaatagagtggtttatggggcaagaaaatctgatagcaaaggttttgctaaagaatttgagatatatggctctacaacatctaaaggagatacttatcaacttgtagcaactggaagtcaaaataaagtatctggattagttgaggcaaaatttaatacaacagaatttaaaagaataaaatttaaatttaaaaattcggatcaaaattgggctacattatcagaaatagcattctataaacaagatgtagtaagtgataaagttgatgatctatttacaaatggattaatgaatgagcttaaaacagagtacaactcaatggaagctatatctaagatagaggaagaagtcaataatcatccattaaaagaagctttaaaaatacatatagaaatagcaaaagatatattaaataatgtagaggttaataatgaatcaattgtgatagcatcacaaagaggtaatgcaaattcacaagcaagtaaatataaaattgcaagaacatcattttcattagagacatttggtagatatgtagttcctggtgaaacaattcaagtttttgttgatgctgatgaaaatggagtaatgcctaagttagttctaggccaaatagcagatgatagaaatggatgggttagaagatattcattaaatccagggttaaatactataactgctcctccatatgataatatgaaacctgcagtagtttacattgaaaatggagctttaccaaatgagcaggcctatgcacctagagtaagattagttggaggtacagcttttccagtttattaccatggaaaaacaaatccagaagagtttgagagggaactagaaaagtatgtagaaaaaattagtacaaatgatgatgatttttcaaatggagtgcctaaaaatgttgtatataatgttgcagaactagtgtctgaaaataatacgatatcaacaagtgctgcaggtgcgctaaaaggtattaaggaattgaagtcaataggaaaaactgtttctgatactatggatgaatgggaacttatgtggaaggaattccaaaaaattagtggtaattttgaaaacaattcagatccaactaaattctataatgcaaaatttacttcaagagtgtttacaaagggaccttatggatggtctgattggggatatactggatataatggaggaaattcaccaagaagagatgggggattctttaaaaatatagttaagccgattagtgctccagggaatgattcatgggcttattaccatgagtggggacatagcattaatagctcttctatggaacatagtgaagttacaaataatatatattctgtaataatgagaaagctaattaataatagcgatgctgatagagttgattggaattcattatataagaggttttcaggtgaaaaagttaatcatggttattggacatatctaggaatacttgagcaagtacaatattattatggggaagatacttacgctaaagcttctaatatagctagaataaatcctgatggtattatgaatggtttaggaggcaatttagaaagattagttataggattgtcattagcaacagaaacagacttaacaacattctttgaagattggggatatgtaaaagctactgataagatgaaagagaaggtatctcatttacctaaacctaatgttaaattagagtatatgaatactataggtcgtgggtatgaaggaaatggattttcaaaagatgctaaagtcgatatacaaactctaaaaataaataaagaaaatgaagagattagtttaacctataatatagatgctgctaataaagatgcgtctatgggatatgaaatccttagagatggtgaagtagttggatatactacaagaacttcatttgttgataagaatatagatataaataaaaattatacttataagatagttgcatatgataaaaaattaaacccattagaatcagaagaaataagttcattttcacctagcataaatattcaacaaaataagataactctagggttaggagaagagttcaatcctctagattatataaaagtattaagctatgaaggaaatgatataatttctaaaattgaagttgaacataatgtagatactagccaaaagggaatatatcaagttaaatataccgtaagtgatgaaagtatatcagtagaaaagatcgtagaagttgaagtagtaagtgattatgaatatctatcggattccgagtggtcatctgcagaaactcaatggggaactccaagaagaaattctaatataaaaggtagagtaaatggagaagtaaaagactttgaaaaaggctttggaatacatgcaaatggtacaataatttatgatttatcaggtaaagactatgataaatttgaagctttactaggagttgatgcaggaatatcaccacaaaataattctagcataaaatttgaaatacaaggtgatggtaaagttctagctgctacagaagttttaaaacatgctgataatatggcatatataaatgtaccagttaaaggtgtggagcaattagtaataaaagttactgatgctggaaatggaaatacttcagatcatgcagtaatagctaaccctaaattaactacaaacaatgctaagcctgttataaccgctagtgataaagtatataaaataggtgaagctgtagactttaatgaagatattggtgcagtggatgcagaagatggagatttaacttctaatatagaaataatatcgaattcatatgaagaaggtaaagtaggaagatttgaagttgtatatagggtaacagatagtgataacaatactacagaaaagaaatcatatattacagtatatgaagactacacagtagttaaatcaaaatatggacaatatgataatttaagtgaatacaacgagcaatttaagataccagtagcttcaataactaacaatggaggaagatactcaagtagtcttatagattatgcaatagataataatcgtaatacacattgggaaactggaacgccaaatagtagttcatttaaaaatgaagttgtttttgacttaggtgaaacaacagaaataagtagaatagcatatgcagcaagaaatggtggaaaaggattcgctagaatgtttgaggtttatgtatctacagaagcagaaggtaatgattttatactagctggtaaaggtgaatatcgtggtaatgttaatgatgttgtagaatttaaaatagctaaaacaagtgcaagaagagtaaaatttaagttcatagaagctaaccaggattgggctagtattggagaaatgtctttctataaggaagatatattatcagataagatagagaatttatttactgataatacgaaaacagatgttaatgaaatttataatacattagaaaaggtacaagaacttagagaggaggtaaaagaccatccagcaattaacttgtttgaagaagatttaaagaaagcagaggatattataatagctaagttccctacaataatggtagaagatataacttatgttaaattaaatagtgaatttgatttaacttcaggagttacagcaaatgatcaagaagatggggacataactagtaatgttacagttaatgaaggcaattttaatataaataaggcaggtaaatatacattaacatatacagtagaagatagtaatggtaatgtagtaactaaagatagagatattgtggtgtatagtgaaagcacttatctatctgatatagaatggcaatcagcagtatctggatggaggactgtaaataaagattcagctgttaattcaagcaataaaataaaacttaaggttaatggagaagtaagagaatttgataaaggtataggagctgcaacaaatgctgagataatatatgaattagatggaaattatagcaacttctcaacatatctgggtactgataaaaattataatgataatagaaccacaataatatttaggatatttgctgatggtgatgagatttatacatctgatgtaataaggagagatagtgaagcagaatttgtaaatctagatgtaactggagtaaaagaacttaaattagtagcagatgatgctgatggtagtggtcttggagattttacttcttgggcagatactaaactatatacaacaaatgcaaaaccaaaattaactattccaaaatcaatctcaactaaggttggtcaagaaatagatttaaatcaggagtatagtgcaatagattcagaagatggagatttaacttctaatgttgaagtaactggtgaagtaaactttaataaacccggaaaatattcagtaacttatagagttatagatagtgatggtaatgaggtagttgaaacaagaaatatagcggtagtaaacatggaagattataaatatttaacagaatatgattggaaatctgcaaattcaggttgggaaacagttagaaaagatgcttctgtaagtaataatagattaactttgacaaatgaagaaggtcaagcagttacttatgataggggaataggtactcatgctacatctactataatatatgatttaagtgataaggattatgcttattttacttcttttgttggcgtagatagagcaatgtatggaagggctggatcaataagttttgaagtgtatgtagatggtgaaaagaaatttgatagtggaataatgaactctagagatcctcaaaaacatgtagaaattgatataaatggtgctaaagaattaaagcttgtagtaactgacggtggaaatggaattgcatcagatcacgctacatggggagattctaagcttcattatgcaaattcagaatccatagattatacagagttatctaaattagtcgaaagtagcgaatgtatagatagagaagtttatactgaagaaagtttaagtatactagaccagaccgtggaaaaagcaactgaaatgatagaaaataaaggggctacttatcaagagattcaatcaatgttatctgaattgaaagatgcaattgataacttagaaagaatagatttaaataaaattattgaaatagaggataagtatttaaaacaagatattcaaaaggctcttgggttaagtggagatataactctaaaagatatgcttgaattaagaagtttaacttgtagtagtagaagagttacgaacttaaaggggatagaatatgctaaaaatttagaagagcttaatatagagcaaaatgaagttagagatttatcacccctaagggacttaaaaaatcttaaggtgttaaatgctagattgcaaataattgaagctggaatggctacagtagaaaataataaagttatacttaaagaaagaatagtatctagaagtggagagatattactacctaaagaaatcatgctaaggagtgaaaaattagaattagaaaattctatagatgagaatggaaatatatcaatagatacatcacaattagaagcaggactttatggtgtttatataacttatgaaaatccgaaagatagccatgaagttggaatactttatttatttaatgtaaattaaattagtaaaaaaatttaatagcaaaaataaaataatagttaattttaacattacttgttggaggataccattactccccaaaatagactaaatcataaatgatttagttcaggctgctgacaaagtgttagcagtctttaattttatacaaatatgaaatataattttaaatatattaatttattatatagagattttatgaatgataaacgaaatggaagtggttatgctagaacaattagttccgcaagattatttattaagaaaaatagataaacatatagatttttcatttattagagatttaactaaggatttgtattgtcatacaaatggtcgcccagcttttaatactatttttgataagattttgaatcccaaattttatccacaactaataatgaaaaaaccctctgtttttaaacagggggttttttaacaaactgaataaaattgctaacgaaataaataatttcataataaaataaattaattgactgataaaaatgtatatgatatcatttagtaaaacataaatagttataactcatagagtaaatacggattgttactgataagcaggcaagacctaaacttttattaatgaaatattaattagagtttagctttttttatgtataaaacgtagagtactatggagtgatttacatgaaaattagtagagtgattaataataatgtaatatgtgttattaatgaatcaaatgaagagttagtactaatgggaagtggaattgcctttcaaaagaagaaaggtgacgaagttgatgaaagtaaaatcgaaaaggagttttccgtaagtaataaaaatgtaacatctaaattgcattcaatattatcagaaattcctttagaacatataaaattatccgatgctataattgaaaaagcaaagaaagttcttgataaagaattaaatgataatatatatgtcacattaactgatcatattagttttgctattcaaaggtttaaggatggatatatttttaataatgctcttttgtgggaaataaaaaaattctatccacaggaatttaatatagggcaagatgcattaattatgatatgggaacagataggaattgaattaccagaagatgaagctgggttcattgcgttgcatattgtaaatgcacagttaaactccgatatgaataatactatggatattactaaacttattcaatctgcattaaagttagtaaaatactactatcatattgagttagatgaaagctctgtatattatactaggtttataactcatcttaaatattttgcacaaaaagtattaagtgataatattattagagacaagaaggatgaactttttggtattattcagaaacaatatccagaagcttttcaatgtgcaaagaaaatagctgacttcgttgaaagagattataataaaaaaatatcagaagaagagttggtttatttaacagtgcatataaagagagttacagctccaatagaggaaaaataaataagatataattattaggatggttactatatattataggcgagacctaagcttgtattaaataattacaagtttaggtctctttttatttttataaattactaacttaaattagtctaaaaagtactctacaggaaactataataagaaaaggagagaatatcatggcaagagattataatcaaattgcaaaagatataataaaagaaattggtggagatgagaacataattagtgcaactcactgtgctactagacttagattaaaattaaaagacagtacaaaagttaataaatcaaaggtggaaaaagttactggggtaattacagtggttgaagccggcggccaattccaaattgtaataggaaatcatgttaaggatgtttataacgaaatggctaaaattttagatttagataaaaagccaagagagggctcagaagagggacaaaaagttgggataataagtaaagttatagatgttatttcaagtatattcgcaccatttttatatgcgttggcagcctgtggaatacttcaaggtgttttatcagtacttacagcaattggagttttatcaacaacaagtggaacttatagaattttaaattttgtgtcatggacaggttttacattcttacctgtactaatagctataacagcctctaaaaaatttaatgctaatactttcgtgtcagttatagctgcttgtgctttaattagtccagattatattaatattatgacagcaaaaacagtagctacactaaattcagcagatccagcagtaagagcgcttatggaatcagcaatgaataatcctgatatggttaagtttatgacagatgtattaaatataccagttacagctcataatttagatttcttagggttaccagtgcaaatgctgagttatacttcatctgttattcctataatattagctatatggattttagcttatatacaaagattttttgaaaagatattaccattagtagttagaaatttattaacaccaatgttttgtttagtaattatagttccattaacattattagtatttggaccagtaggaaatgctataggtgggtcaattggaagtgtgtataacttcttatataatttaagcccaatagttgcaggtgcagtagtaggtggattatggcaaatattagttgtatttggtgttcattggggaattacaccggttacggttggtaactacgcagcgcttggatatgatacatttacagcgcttcaagcatcagcagtattttcacaagcaggggcaacctttggagtattattaaaatcaaagaataaagaacttaaaaatgtatcactatctgcaggtattacggctttatttggaattacagagccagctacttatggagtaacattaagacttaaaaagccattaatttgtggatgtatagccggagcagtaggtggagcagtagcaggttcatttagagctttatcttggggatataatatgccaggtatagctacattgccagcatattttaaggaaggatatatgacacaattcttaggactgttattatctatagttatagctttcgttcttggagttgtattaacatatatagtaggatttgaggatccaatagatgaggaagaaattgaagaagataaagaaatcaataatgaattaaaagctggaagagaagtaattactagtccaataaatggagtggcaattcctttaacagaggtaaaagatgcagcttttggatcagaaatgcttggaaagggtattggaatagtaccggtagaggggaaagtgtactcaccatttgatggaacagtggaggctttatttgctacaaagcacgcaataggattaaaatcgaataatggagtagaaatgttaattcatattggtttagatacagttaagttagaaggccaaggatttacagcacatattaatcaaggagataaggttaaaaaaggtgatttgttagtagaatttgatatagactttattgaaagcaaaggatatgacttaacaacaccagttgttatttcgaatacagcagattatttagatatatttataacggaaaataaatcattacaaatagatgaagaagcaattacaattgtaaactaataggaggtaaagtaatgggaaaaggattttcaaaaaattttttatggggtggagcagtagcggcccatcaagtagaaggtggatggaataaaggtggaaaaggtgttagtatagcagatgtactaacagcaggtgctcacggagtggatagagtaataactgatggagtattagatggttataattatcctaatcatgaatctgtagatttttactcaaactataagggcgatatagctttatttgcagaaatgggatttaaatgttttagaacatcaatagcatggactagaatatttcctaatggagatgatgcagaggcaaatgaagaaggattaaagttctatgatgatatgtttgatgaactattaaagcatgggatcgagccagtaataacattatcacattttgaaatgccatacaatttagttaagaactatggtggatggaaaaataggaaggtaatagacttctttgttaaatatgctgaagttgtaatggagagatataaaaataaagttaagtattggatgacgtttaatgaaataaataaccaaaagaactataaatatcctctatttggatatacttgttcaggggttatttttaacaaagaagaaaatccagaagaaacaatgtatcaagttgttcatcatgaattggtagctagtgctaaagtagttaagagagggcatgaaattaatccggattttaaaataggatgtatgattgcatatgttccaatttacccttactcatgtaatccagaagatattatgtacgctgcagaagcaatgcatgataggcatttatttgctgatgttcatgcaagaggagcttatccaacgtatgcaagatgcgaatgggaaagaaagggatataacattcatatggaaccagaagatgaagaaatattaagagaaggtattgttgactatataggattaagctattatatgtctaatgctgttaaagcagataatgtagtagaaggatcaggacttgatggatttccaggtagcgttccaaacccatatgtaaaagcctctgattggggatggcaaattgacccagtaggtttaagatatggattaaacaacttatatgaaagatatcaaaaaccattatttatagttgagaatggatttggagctatagataagttagatgaaaatggggttgttcaagatgattatagaattgaatatttaaaatctcatattgtagaaatgaaaaaggcaatagagtttgatggagttgaacttatgggatatacaccatggggatgtatagactgtgtgtcatttactacaggagaaatgaaaaagagatatggtttcatttacgtagataaagataatgaaggaaatggaacattaaaacgtagcaaaaagaaatcatttgagtggtataaaaaagtaatagcaacaaatggtgaagaattgtaattagtgttaagaagtagctatattcaggttgaatttaaagtttaacctgagtatagttttttattgcattaaattaatggagttattatatataaatgttacttttaaattatatattaatttatgggggttaaagatagcattagggactatttgtgcatttgtattaaagtttaatccagttttagtatatttaattttatctagtgatgagttttttaggctttagtgactattccgaggatttggaaaggaaagcggattcattatacaactgtttagttaaaatcatataataacagaaaattataaataaagatttatcaaattttatagtaatatgaatatttttaagtgaaaatgggtaattatattaatgagatgttttgatacatctattattttgaaatattatcacaatattattgttaaacttatcctagtgtatcaatagtaggataaaaaagaaaaacagtagaaattagtagtataaagagtttaattctagaatttagataaattatatatcttgttttagataatacatgataatattagatacgtcgctgacagcagaaaacaatatgtttatatgatatgtaagaagcgataagttcttaaagaaaaatgttgaaagtttttgaaaaaaagttattgacatgaatcggcaggaatgataagataaggaagtcgcttcggtgcgacagagtaaatggtctttgaaaattgaacagaatatagttaaagtaaaccagcaattcttttgagagtttcgaaccctcctttttttatcggctattatcaaaatttattttgatacagccccttttcttttttattactatttttataatattaacactttttattatttaggcttaaaattaaatcttttatattacaattatcacttattttttaatttataatctcttcctcaatactgtttcatttataatttacatatatcataaacttcactatatataattctaatatatcccttttattatttacagttaaaatattatttagtataattttttcagtatcaacccatatagcttgtgggaaactataaataatcttcagataatttttttctagaaaataggtggtgaaaattactaatgaaaaatattaatttttttgtttacggaagcttaagagaaggattttataattatgataagtttttagccggaaagatttttaagaaaaaagaaggcaaattaaataatattagattatatcatatgccctataaaggttatcctgcaatagttccaggtggagattatgtattaggtgaaataatggtcattaataaagaggattatgattctactatgaaggcacttgataaaatggagggctttataagtgaaggaaattctgaaaatgaataccataaaatgcttttagaagttcaagatcttcaaaataatcaaaacgaactatgttatgtgtatttttataataaagatagagacaaactttttgataatgaagcaatctaccttcctaacggaaattggaaggagtatatgttaaataattcaattatttaaagaaaactattaaaacattaatataaaaataaggagatattcttagtaatatctccttatttttatattaatgttttgatatttacaatgctaatccttcttgtaacattttcttaaattcttcccaagttacaaactttccacccatactttctaaatggtttgtatgcatttgacaatccagaaaaatatatccctcttcctcaagctttttacagatgcttattaaagctactttagatgcattgctttcctttgaaaacatactttcaccaaagaaacaccttcctatcttaacaccataaagtcctcctacaagttcttgatctttatatacctcaacacttgtggcaaaaccttttttatgtaagttgatatacgcttccattatttcattagttatccatgtaccttctttaatttctctaagttctttgcagttttttattacaccattaaaatctttatcaaaagtaaccttaaactcacctttattaaagacccttttcatggattttgaaatattaatcgcacttggttctattataaatcttggttttggacaccaccataaaattggttcaccttcactgtaccatggaaaaataccattgcaataagctaaaataagcctttcaaaacttaaatctccaccaattgctaataatccatcctcttctgctaaatcaggatttggaaacattatttcatcacttaattgatatactgacatatactcatcactctctcgttacttttagtaatcattttacttcagcaataattataaaactttttattaatttcatatcttcattttctttacttttatatgatatttcatttatctcaatatcaacaattctacaccctaaagattctaacatatttttatcccactgtggacgtattattttacttaatggtaaattataagctattttatctatagattcagtacttactcccatcatatttttatgatcatttatatgagtaatactttttctttcttccatatatctttcatcaaacatataacaataatgatttccatcaaatattattaatttcccacctggttttaatatcctaatccactctttatatgccttttcaggattctccaaattccatattacatttctacttactaataaatcaaaggtattatcttcaaaagtaggattttgtgcatcaccttgaatagtgtgaattttaacgcctaaatcatttgcattttcttcagctttcaaaagcatgttttccgtacaatcaaatgcataagattcacagcctaattctgctaatagtattgctaaaaaacctggaccacaccccatatctatagttttaaaattattttgtggtgaaatatatttttttagaaattcttcatattcactcttttcattactttctaaactttccctattactaatagaatatccttctgcccttctattccaataagcttttatatcatctaaataattcattttatcctccgttgtactttttttcatattacatttaaataatcgaatttataagattttttgtaaatacttctcttggatttaaaattacctcatcagtatttccttcttcaattattttaccttccttcattactaatatataatcacaaaattgttgtactaatgctatatcatgacaaataaaaagtattgccatatctctattcttttgtatattcttcaataactttataatattaaattgaactgtaacatctagtgcacttgttgcctcatcacaaataagtaactgaggatcgctagctaatgctctagcaattgctgccctctggcattgtcctccacttacctctttaggatatctattcgctaattcatatgataactgacactcttgaaaaagcatctttaacttttcttctttttcaactgaagttaaactttttttcatagcttctttaattgatttacctagtttcatccttggattaaaggattcagtaggactttgaaaaaccatttgtatctttccttgtatttctttaagcctaactttcgctttattacttaatatatttccacctaaataaatttctccatcatcaaaatttaataatcctgatataattctaacagttgtacttttcccacagccactttctccaacaattccaacgcattgtccttcgttaatagtgaagcttacgtcatctattacaatattgctttgtccatctttcaaaaatgacttttttatagatgataccttcaatatctcttccattacttaccacctcactaaacaatctttttcttcaatttaggcgttgcattaattaactcttttgtatatcttctacttggataattaaatatattttctgctaaatcatactctatacattttccttctttcataactaatgcactatcacacattgaagatattactctcatattatgacttacaattattatagcagtcccatatttatttcttaaattcactaattcatctattacctttgcttgaactgttacatctaatgcactagttggctcatctgccaatattattttgggattagatgccattgccatcataattcctgccctttgattcattccacccgataattcaaaaggataactattaagaaactttttagtttctttaatattaaacgtctttagaatctcttctcctttaactagtgcttctctttttttaatttttctatgagctctcatagagtcatataattgacttccaattgttctaattgggcaaaaagaagacttacaatcttgaaagatcattccaattgattttcctcttatctcaattaattcctttttatttaaatgtgtaatatctcttccttcatatataatactaccatctacaatttctcctccatctccaaggataccaattatagattttattattgtactctttccactacctgactcacctactataccaagtatttcaccttcatatatagtgaaagaaatatcattaactacaagtttatcattatattttatagatacatttttaagttgtagtaatggctttttcatatatcctcctatctattttactgaaagatttgcagtaatctcataataatctgatggatgcgcttcaaatcctgaaacatttgacttcattacaaacgacatttttaagtgagatgcaaaaataaatgaagcatcatctaaaattatttgttgcatttttgttgccaatttccctctttcggatgcctcaaatgtattactcatttcatcatataaattttctaactgttcattataatatttcccacgatttttagcagaatcttttaatgcatgtgttgtaaagaaatatgcaggatctccagttggtgccgttacaaatgcactggcatatatatcccaatctccactttttaaaacatctgtatgatttgctgttgaattaacctctacatcaattcctatttcttttaaagttgcttgaacagactctgcaagaagcggtaattcttgtctccctggatatgttaaccatcttatagttaagttttctccatttttatctacatatccatctccatttgtatcttcccaacctgattcttttaataatgcttttgctgtatcaacattgtattctggagctgttacagttttatctccaaatgaaaaattttcagggaatggtcctacagcaggagttccatttccatttaataatacatctgtaaatccttctttatctatagcacatgctattgcccttcttacatttatatcttgtaaatttacattttcataattaatagctccaaaaaaggtacgtgatgtatctgttgagcttattttataatcactattattttcaaataattgtaaactcgcatatggtaatccttgtgttgcatctatttcaccactttgtagtgccattgtaagtgtatcaccatctgtaatactctttactatcaccttatctgtctttacttctcctccccaataattctcatttttaactaattcaatttctgaatcagatattttctctgcaataaaaggccctgttcctgctacatttctatcttctgtaataccatattccatatcaattattgcagcatatggatcgcttaaataatttaataaatctacaacctttttattacaagttattgttatactttgtccatctgcttctatttcagctatatctaaatcacctggagctctatcatgaactgaaataagatcttctaaacattccttaaccgatttgccatccatttttcttccacttgaaaaggtaacatcatctcttaaattaattttcatagtattatcatcaatttgttcataatcagttgcaagccacggttctaattccatattttcattaaatttaaataatgtttccccaacaccataccttactgctgaccagcctgaataattatcatgtggatttaaacctgcattccccatttctggaccataagctgttgttccataagtaaatatactttcactagaactatttattttactattatttgtttctttatcagtacctttattgcttccacagccagttaatattgatgtaaaaataaaacctaccattaataaacttattagttttctttttctcattttaacgtcctccctctaataaaattttttatttgaaatatttattttatatcgatataatcccttattgtatctccaagtaaattaaaacacattattgtaataaaaatagctaaacctggcgctaatatcatccatggtgatgtttgaatcatacttcttccatcattcatcatacttccccactctgccgctggtgctatagctcctaatcctaaaaaagaaagcgctgcaagttccatcatcattgtaccaatatcaactgcagccattacaattattgtacccatagtattaggtaaaatatgcttaaatattatttttatattattcaaaccattaagccttgcagcatcaataaaagattgagtttttagtgtaattgcttgtgttcttgctattctagcatatttaggccagctaattactgctaatgcaattactgcactttgcattccacctccaagaactgatgcaactgcaatagcaaaaaccatcccaggaaatgctaaaaacatatctgcaattctcataagtatactatctctaattccaccatatacaccacaatataatccaactgatgttcctattgtagtaattatcaaaattaatgttaatgttgaaaatatactacttcttccacctactatcactcttgaaaaaacatctcttccatatctatctgttcctaaaatatgtgctaaggatggtgattgaagtgcttcacttaaattttgagcatatggatcgtatggtactatatattctgaaattaatgctattaaacaaattaatgcacaaatactagcaaatataatcaatttaattttggtttttttctttttgctcatattcttaactactattcctttcctaatctaattcgtggatctaaatagcgatgcacaatatcagatataagatttattgctacatatataaatgccatccaaattacataagcttggatcataggataatcatacatattaatagaatctactgctagtttacctattccatcccacataaaaatagtttcaactattgctgttcctccaagaagagatgctattgataaagctaataatgtaataatagtcattaatgaagatcttaaaacacttttaaataaaattgttttatatcctattcctcgtgcataagctgccttaacataatctttatttaattcttctaatactacggctcttacttgtcttgtatatttacatatcattgcaacagaaagtgttaatgttggcataattatgctcttaaaattaacattatttaatgttcctattactggtagccattttaatttcacagaaaataaaagaattaacaataatgataagaaaaatcctggtagagcattacctataaaacttaatatccttataatataatcaatgattttattttgaaaaactgctgcaataatccccattggaattgctattagaattgtaagaactattgatgaagccattaaaaggaatgtatttggcaacttcgaaataattgttgtaaatactggctttccagaaacataagaaacacccatatcacctttaaaaattcctacaacccactctccatactgctctaaaaatggcttatccaatcctaattcacttctcatgttatcttctacctcttgagaaactactccaccagtattttctattaatttatctactgtatctactgttgtagtattcatcattgcaaaagtaataaatgttattccaaacaaaattggtataagttgaagaaaccttttgcatatgtatcttaccataacgctttatttcctcccttttgttttttatatttctataatcaaaactaatttaatcactttatacatttaactaaaaacataggcgttgatgcataattagctttttcttcttcactccataccctcttccatatatctaaatcaacctttattgatgttactccaattttatttaaagttgaaatatcccactgtggtctcatcattttgcttaacggtactcttcttgctatatcttccatagattctatatctgtacatgtgtaatgatcctctaaaccattttcagcaacttttttcctatcattctcatattcttttctctttttatcatcaaataaatgatgataccaattagcatcaaaattcaataagattcctttttctcttaatactcgaatccattccttatatgccaaatcaggtttttctaaattccatgttaaatttcttgaaactataacgtcaaaactgttatctttaaattgtaaattttgtgcatccatctttataaattttattttattcactaagtcccccgcattttcttttgctttctcaatcatttcattagtataatcaattgcagtaacattaaatccagcctgcgctaatattatagaaaagaatcctggtccacatcctatatctaatattcttatattatcatttgatttctcttcacttgatcctatttgcattttaatttcatttaaccacttatctctttgaagtgattctaactcgtctttattaacctctgaatatccttcagctctatttgtccaatattcttctatttcgcttaatatctttaacatattacacctcttacaactatattccacaagaaagtatatcaatagatattatcattcacaaccctcccccccggtaatttttttgcaaaaaaaaatatcactggctttattttataccagtaatatttttctactttataaattgtgctattgctttgtttaaatcatctatcgcctttttatctcccgattgtactgcatcaactatacaaccttcaatatgctgttgtaaaataatttttccagcattattcaatgctgatgttactgcagccaactggattaatacttctgtgcaatctctctcatcttgtaccattctctttacagattctaaatgtcctattgcacgtgataatctattaataatagccttggtattttcatgtgaatgtttgtgagtatgacttttatcactaccatggacatgtgaatatatctggccatcattcgatatatgaatatgttcttcattatgtttatcttccattctatttccctcaaacattaaacttattataaataactctattttattatatatctataatagtacctttacaatagagttctgcatatattatgcataaaataaaactatatatcatgaaagatactttcaaatcattttttaatatttaaagacacacttcaattaaataatataagtttaatgtatttactttttcactattgtatttatcctaaattaataatccaggcatcatcaatatattctttaataatataactaactaaattagtccatccatcacatttatctaaaataatagaatcactacttacaacataattacttttttcaagtataatatcagggttaataactatataaacatttacattaacactccaattctcagctgctttataaatcgccattttaagctttcctgaattagaaacaggcgcatctatataaaagttaacacattctaattcaagactgctaaaagctttccctaaaatttctaatacatcatatgttttatcgatcaatctataagtaccccttagtcctgctaaatctcttatagatccatccatacactttattaatacccctttagacaatgccacctcaagagaaataataaaattaaatgcatctatatttatagtttttccttttaatctagatacacttatctctttatcttgcctcaattctaaatccttgattgaacaacttgctcttctaattgccatgcgttgccttgtagaaaattgatgtcttccacctacaaaatcaattatattactaataggataatttctattaagcaaccaaactacttcttcttgcgcacgctttaatttttctatctccttgcttgaaaaaaatctttcatctttatcttccttgcctctaatagttattttttttatttcttccatattgtattacctttcatatctatttttaatagtatactacttatattttatattatttttctttatattataaaaaactcactaaatataaacttctattatttatcttagacaaaaacttgtacaattatcatataacatacccttcctaataaaatacttaaaaatactcactaccaaatatcagtaaacatataattgatcgaacataaactatacattatatttactctttcccactaatataattgttcttttatatactgaaatattttaaatactatcagtaaaactcctaaaaaaataagaagcaaagaaatttatacaaactcctaaggaatttctatacacctcttacttcttaaatcaattatcctcttataacttcaaccttatatccatctggatcagttacaaagtaataatgaggcttttctcctggaagcccctttaaatcagtaacttcgtatcccattttaatatgtttttctcttaaatcttcaatatcatcatgagctatagcaatatgactaaatccatttcctaaatcataaggaacttctggattatagttataagtaagctctacttcataaccacctggggcatctgataaataaactaatgtaaatttatgatccgggaaatcctttcttcttgtttccacaagacctaaagcattcttataaaactctaacgatttttctaaatccataactcttacacaagtatgtaacatcttaactggcataatatacctcctaaatttaaacttgtataaattatagcataaattattttaattttcagcttctaaaataatcttatgatcaactaattccatttctttaattcttgctctaatagttttcctttgtataacaataactagattacaattattaataataagttaaataaaaaaaataatgcatatgaaaaatcactttaataagcttttttcatatgcatatttctataataaattattgtaattcatcattttgaacaatttttgttttagccttcttcttctgtttaggttttttttcatttctattctttgccaaactatcttcacctcgcttaaataaattaatgtaatagataattacattaattagattgctcttatttatgtaaaataatactggcaattatatcattataatccaaatcttaaactcttttaggctaaaattcccttgttacattccttacccacttaccacttaaaactcttacaactgcaataattgattttattacctcattactttttaccacaaaaaacactgctgcaattggctattttaatacaagggctgtgataaatccacaagatattgctacaagccataaaaaaataatatcatttaccccagctagtccaaatgttaatctcattaatatgaagaataatttttttcaacttatgctactgatagttgaacttctcctaaggatcctagcatcatagtatcaagcatacttactgcaaatgtaattaagttttttattgcaatagataaagcaatacttaaaattaacttataaaattttttctctctgattattaacattatcttatccactcttttctctcatatannnnnnnnnntataaaagctataactttatacatttaatactctttatactaaaacacaactatttatatttttcatattatttttttagtcctatatccctataccataattaaataaattcttccatatatatttataatttttcattttttatttataatagttctatataaaaaatatttatttcttaattcgaagggagaaaaaatggggaatactattaaattaactgccttaactaaaacttctggatgtgctgctaaaataggccctggagttttagattcagtattaaaaaatctacctaaatttgaagactcaaatcttatggttggttttgataaaaaagatgatgcttgtgtatataaagtaagtgaagataaagtccttattcaaactgttgactttttccctcctatggttgatgatccttacatatttggacaaattgctgctacaaatgcattgagtgatatttatgctatgggtggtgatcctgcaattgcaatgaatttattatgctttccatcttgtttagattcatcaataatgcatgatattttagctggcggatacagtaaggtatctgaatctggtgcaattgttagtggtggtcatactattgcagaccctactcctaaatatggactttgtgtaactggatttgctcatcctaatgaaatccttactaacagtaatgctaaaactggtgatgtccttgttcttactaaacccttaggcataggtattttaaatacagcaactaaagcagaattactatcttatgaaaaaattaaagaagtaactaatgtaatgacaactttaaataaatatgctaaagattctttaaaaaacttaaatgttaattcttgtacagatataactggatttagcctaataggtcatgggtatgaaatggcaagtggaagtaataaaactattgagttctactctaattcaatacctcttattaccgattctctagaatatgctagaatgggaattattcctgaaggaatgtataacaatttagaatatttaaagaatacttttgactgttactcctctgttactcaagaaatgcaagatgtactcctagaccctcaaacttctggtggtctacttttatcaatgccagaaaaagatgctttggaatatatatcaagaatggaactccataatccttggacaaaaattattggtactgttactgataagcaatcacattcaataataataaaataatatacaattaaaaagtcagcataatacaaaatttttctattatttatagtaaatagaatattctaaattatgctgacttattatttaaccttatatttttatatactaaataatattttttaatatttttattctaatataattcattaatcttctataattatatagttatcacttttgatacctgtttcataacatttgttatatcatacatgttactaacttttcctacacctaacacgtcttctaaaccataaaaattaaggcaagcaccacaaactaacatttctactcctttagcttctaaaagttttaaatgctcaattgcttgctcatttaaggttggaactttcacgcctccattcataaataaaattgaacttggcaagtcttcaccttcagaaatagtatataagaacatcttcattaatgatttacctaactcatcatctccactgccaatggtttctttattcataaatacagcccaatttcctaattcttttttctcttctaatttatttaaaatatcctcacattcttcacatccattagaaaattcaactttaaagttacctttatcctgtataatttttatttcaaacccttgattttttgcaagcttttttaagttttcaacagcaattttattatctacttcaatttcaaaaaaattaactccagattctatttcctttttagccattatcactggtattggacaattctttcccttagcatctataaattttttcataacttactccctaatctttcatttatttattcttattactcatatacattattgcttctaatactccaccacctatagatcttgctttatctgaaattgtaaaacaatgatctctttcacatcgtggatcaatatctccagccttcatacctttaaacacttcaatattttcttgtaacattcctcttactattccatcaatttgcgctaaaacttcttcttcatctacataagccactacttcaccttttttaacaaaatcccctattttaacaattggctttattttaccatttgctgaagctcttataattctttctttagtatatccaccaatgttacctggaacccctgtatttggtatagcactccccttctctataactttacctaaatagtgacctcttttagtttcaactactaaatcacagtcaacctgtgcttcaaatcctggccctactccaataactatcggtgcatcatctatgcttgtacctaaatttttctttgcaattatagaatctacaactacattaggctttaactttgatacaatttctgctttttcatcaattataattggtatattacctttacttatcgcttcatttatctcatctatactattaaccttaactcctttaattccttcaatagttatttcattatcaaatatagcttgagaaaaagctactgttcttcttacggttgtaggtttctctatttctgtcattataatatcaaatccactttttcttaatctgtatgctataccacttgctaaatctcctgcacctttaatcactattagcatctctacacctcattaaactctttataacttgtaattatactttttatattgttttgctgcaaatattcacatatttcttctgctaactctaacaattccttgttatctaccttattaatcactgctctataaacagcatttctacattcattgactccttttttttgcccatcttcactacttaataaaatagctatatctttaggtttaataacataattgtcatttttctttaatatattacaaacctgctgtggcctatggcatgtttcctttatgcttttatttaatgagtctattccagcaaccccaacaaccattgtagtattttttaaaataacaggttcatggcttgctggcgccttaagaggtaacatttttgctccatcagcttcaattattaaaaaatcacataaatttattagagtctcagctatatcttcaccaacacttgaaatcttatcatttttttctttaattcctactgtaaccaaattatatgtttttaatctttcaattatttcattgacatcacctttaaaatcaatacaatcctttggcatatgcatatgtgttgtagttgtaactaaaacctttttacctaaatcacttaactcctttgccaatgtgtaaacagatgttgtttttccccctccaccaacaaaggaaataatactcttttcctttaaattcattcctaaagcttcatataaatatctttcttttcttattgaattattttcataaccataaattttcatattaattccttacatttcactttatttaataatttattaaaatatttttaacgcttattcgcattatattttcccctttattatacaaagttttacttgttttataaatacttaataataaattaaataattcctataaatattagtatctttatataaaaataaaagccaccaaattaggtgacttttatttattcttcatataagttatcttcaattattttattagccaaaataccaatgtttacttctcttatatccatataaacatcaataattctatctactaaagttacttctacatattcaatgtcttttccatcttcatccttataagtaattatatcatatgttattatatcttcttttagttgttttttacttatcatttgcttctccttaattatattatttttaacaattgatcaaaagagtctattgaattataaaactcctctacatttccaaatccatattttgcaaatataaaaggaacattagcaaatttcgctgcatttgcatcaccttgggtatcccctacataaacaggattttttaagttattcctctcaactattagcttaatattttcacctttaggtaatcctgttcttccaggacattcataatcaataaagtatttatctaatttatgtgctttaaagaaacattctatgtaaccatcttgacagttactaactataaatagtttataattttttgataattcctttaatgtatcttctaatttatcatatagtgttgcaccataatctcttaaatattcattttcatattcacaacattcttttattactttaagttgcattttagcatctagctctggtaataaaatacttgctatctcatccaataattttcccatacatggctttaagtcttcaacagttacttctttacgctttaaattatattttgcaattatactagtccaagtttttgctacttctgcagttgaatcccataacgtcccatctaaatcaaatattattccatcaaacttcattttatcctcctagtatatctttttaattattatatcatcttttcatattattatcattattagttatatctactttaaataaatttaactaagcaaaccaaatatatggtttaaatatgtaacatatgtaaaagtaagttaataaaatatattgtaataacggaggtaagcttatgagaaaaaataaaaataaactcttacatgcattaattaaatgttggaatcaaatagctattagcgataaatctttaataattataatgtttatacttttacttcaatgtatctataatttatttatgcctgaaccttcaacaaatagtggaatatctattagtgttatcatacgtactactgttgcttctatttttggttactttttaagcgaaaattttttaaaacacgaagttataaagagcagtgattctaactctccaataatcgttacaatagatgaagatgagttagacgataaagaggataaagaaaagtatctaaaagacgaggatagaaattgtaaaattgaaagtaaaaataaatccaataacctttcaacggatttaaaatattacatttgcaataaatcttttcaagttattgttgctttatcagtttgtgtaattgctttatcttcgctaattataggatatgatttcaacctaattcctgaagaagccaatccatctataatacaatttagagacttaataagtagctgtgtaggatttttattaggatgttcaaggagtaattcaaacaaaaattcatcaaataaataaataaaaagccacaacatattttaatacattgtggctccttattataatattctatttactacaactcttgcttatattaatactaagtacttatattccttaaaatcttctataaataacatttaatttctacaactttagaatatcataatacttttaccattcacccattaattttctataaagcccagcatactcttgtgctgaatttctccaagaataatctttttccattcctctaaatgctataccattccatttatctctatgatcaaaataaatatgtttagcataattaattgtattaagcatttcatgagcattataatttgcaaatgagaagcctgtaccacaatcagaatatatattaaatggttcaacagtatctcttaagccacctgtttctctaactataggaacggttccatatcttaatgatataagttgtgttaaaccgcaaggttcaaatctagatggaacaagcattgcatcagccgctgcatatatcttatgagctctgttatttgaaaaataaatattgccagatacctttccttttaacttccactcataatatctaaacatatcttcatatcctttatcaccagttccaaggactaccaattgagtgttatcatctacaattttttctattactctagcaattaaatctacacctttttgatcagtcaatcttgatattatacctatcataaatttattatcattttcttctaatcctaattcgtgttgtaatcctcttttattatataatttattttctataaaactatatttattatatttactgaatatttcattatctgtttcaggattatactcattataatcaataccatttaatattccataaagatctcctgacttttggcatactactccatcaagtccttcaccatagtaatcattttgtatctcatttttataactattacttacagtagttatataatttgcataaaccattccaccctttaacatgttagcttccttattatattccatatcagtaggtctaaacacataatctgggaaattagttattttttgaagagtgttaatatcccaaattccttggaatcttaaattatggattgtcattatagtttttatattatcgtagaaatgattatctctaaatattgtgtgtaaatacacaggtaatacccctgtttgccaatcatgacaatgtattatatctggtctaaaatctatacttggtaaaattgataatgctgccttactaaagaagcagaatttttcaatgtcaaatctagtatctccatatggagtatttcctccaaaataacgttgattatcgataaaataaaatgtaattccatcatattgtgttgtcaatacaccaacatattcactaccagtgacttgtcctagatccatataaaaatgtgtaatatatttaaaatcacttctgtagtgccatggtatacatgtataatttggtatcacaactcttacatcaaactcttcttttggaaatgatttaggaagcgatcctacaacatctgctagtccaccagttttaataaatggtacacattcagaagcgacaaataatatttttttcatctcaaaattcctcccgtttttaatctgttctatcctatattatgttatttaaatttaatattaattttctcaaattctaataatattttaccatattcccatatttttgaaatagtttattgttatatttacgaataaaatttctgtaaacctttctaaataacattttaattaattttattgtctttttttgattagttggtaattttttacttatataaaaccaattttgtactaatatatattctatgttataattatattgaaataattttatttcaacactttacattaaaaggatgggattattatgagaaataatgcatatgaaatcatgaaagaaatgtggtcaattgatgaggaaattcaaaaacttacatccgatttaaagaaaacagctcaaattacagaaagagaagtattagaacgacgtatagattcattatatgctgaatttttgaaatataaacatttactacaagatattcaagttacaggcctataataaaaaaaagtaccaaacaacttcgtttggtactttttttattatgctactttatctattgaatccttatttcttccatatcttttctcatatctagaaattaagaagaaagcaattaatccaaatactattggtccagctaattggaatccagtagaaacataatctttagtttcaattgctggttgtaatattgtaaatatgttagcaaatccaaccgtacaagttactattatagcccatattgttgcaactgttttacttttaaagaaaataaaaggtttatctatactatcatttttcttaaagtaaataaatgcaattgataagaacatagttggtattgtcattgctacatttcccataagtattaaataatctaagaaactagaagattttccacctgttataactgcaattataataatagctacaaccgctatacattgcatccacattgcatttacaggcataccattttcatttattgcagtccatttttctggccatatctcctttggagtaccttctattaattgttttaatggcgaataaattaatgtaaagaatgcccccaataaagctaagaacattgctaatccaatatatctagcaaaccaagtacccattatctcaactccatgtggagataatccaaatacttcacctaacctaactcctaagtttttaataaccacatatgctacatttgccattcttacatcaggatttgaaagtacctcttgccaattagtaaataaaccaaccatcaatattgctaaagagtaacctacaccaattactattgctgaaattttaattccttttggaaatgtctcattagcattttctgtttggtcaacaagtccaccgactgcttctaatcctccataagcaaatatagcaaatactaaaaatcctaatactgctaaaacacttccataagctggattaggtgagtgtgcaaattcagataaattcaatggttgtgctgcttgaaaaccattagcaaaaaatactattaatgaaccaactattaatagtacatttgcacttgttacaaatatacctccaatagatgcaacttttgaaatactattcaaaccttttgatgataagaatgtaattaatataacaaacattgctcctaaaatacccaatgtttgtgaagaagtaagtccaaacaatgaccaagtagatgttttatcagttccaaatatcaaattagaaagcggaacccatatagatgatgatacactaaccatccaaactatatatgatgcgaaccacataaatgtaccaataaatgcaaactttctaccaatagacttttgcatccaaacataaatcccacctttttcttctttaaatgctgctccaaattcagccatcataaatgcataaggaataaagaagcatatagctccaaaaatataccatggaattgctgaatatcccataaggaaaaatgcccttggaatattattaaatccaaatactgatgtaaaaatcataagtattaatgcaattaaagttagtttacctttattattactcataatatttcctccctagtttaagtaagctatttttcatattatagcttttttgtcgaattttatttcacaatatatattatcataataacttcattctttccaccctatttttttacaaaatagcacattttatatgattaaattaaacttatactatttgacacttattttatttaaataatatttaatatatatatataaattttatcatattatcattttgctttattgtactaaactattaaattgttaaattattttttaaacttttcttttcacttattataatttcattttttatataaattaaacatttaattttaatttcccattatttctttcttttattgaagtttaactcaaaaataaatatactttaattataagtatatttactttaataatacgacaaaggagaattttatgaattacttatctgatttgcatactcatactatagtgagcggacatgcatacacaacccttatggagaatattaacttttgttcagaaaagggtattaaaattttaggtacatcagagcatgcgcctactatgcctggagctccacattactggtacttcggtaatctaaaggttcttccaagaataataaatggagtgctaattttaaaaggatgtgaggctaatatccttgatgttgatggtaatcttgacatgcctaacgacgctataaaaaacttagattatatgattgcttcttttcatgaacctgtatttgaaccaaaatctttagaagaaaatactaaatctattttaaatacaatagataagtatgaaaaagttgaaatactaggtcatcttggaaacccaaattataaacttgattatgatgcaattgttagaaaagctaaggaaaaggatattatgattgaaattaataacagttctttatctggaacatcaagaattggaagtaatgttaattgtgaaaaagttgcacagctttgtaaagaacatggtactaaagttattttaacttctgatgctcatattaatttaaaaattggtgatttttctaatggaattgaattattaaaaaaaatagaaatgcctaaagagttaatcatgaatgatcctgataaattaatttctcacctaaaaaataaaggcagattacaagatttataatatagtaatcttataactaaagtccttcttagatttatttatataaatttatgataattataaaaattagctgatatgaaaatgatatactctctttatagtagacagttaaaataataaaaactgttactatgaagagagcattaatacatatatagacttatattacttatttttttggtctattcaaaaaaacgtttcatttttaatcttaatctttccatataatttttatatggtataattccataaacgatatatatatattcaaagaatatttttttaaatattgctattatagctatgtttgcttctcaaggaaagattttgattcaaaattatcacgtattactaattttattagctccaattttattgttctttataattaattttatatttggaagattaacaagtaagattattaaactaaattatgaagatagtgtttctctaaatttaactactcttgctagaaattctcctatagcactagctattgctgtagcaacctttccagataagccattaatctccttagctcttattataggcccattaatagaattacctatattatttttaatttctaaaattttattgcttataaaatctaaagaaaaatcatatttatataattaaatttaggcttgaaatataaaatagctcactaagacatttaaaccttagtgagctttaagcatatttattttttttaatattatattaaatatgcactcaataactttattgtattttcaagagcatttacatgagttctttccataccatgagaagcatgaacccctggtccaataagtgctcctctaatatcatttccagctcttaaggctgcactgacatctgaaccatacattggatatatatctacagaataacttaaattgttttcttttgctaaattaattaattcagtagtcatattataatcatatggcccactagaatctttagcacaaattgatacatcatattctgtacaacttaaatcatcacctatacagcccatatccactgctatcatttcactaatatcagaaggaatagatgctgaaccatgaccaacctcttcatatgtagaaattataattttcacagtatttttaggttttaaattttctctatgcagcatttctaacaatgcaattatagctgcaacacttcctttatcatcaataaaccttgatttaataaatccactttctgttattgtagtctttggatcaataaaaataaaatctccaactccaatacctaacttttcaacatcctctttacattttacaacttcatcaattcttacttccatgttcttttcatctcttggtttagatttactatcttcaaaaacatgagcagctgggctagtacttaagaatgtaccagaataaagttttccttctctagtccttattgtacaatattcactatctaatgtaggtaaaataggtccacctaatattgtaaacttcaaatttccacttggtgttattgatctcaccattgcacctaaagtatctacatgtgcacacattcctattgttttttcattgcttattccttcaactgtaattattccgcaccctttattatttctttcaaatttatgtccaaaaggcttaataatctcttcaatcctctccattatttcaaaacaaaatccagtaggactattaaattctaatatttcttttgctgtctttaataagaattccctattaacactaaaattacttttcattttctccccctaaaagtcaatattattttttatattattaatattatcatatttagccttaatctagtaaattttacttaattttatttatcttctttaccgcacacagaaatatccttaatattaactcaatttatgaattaatattaaggatattttattaatatattactgtttaactataacttataacttattaatttataatatactcttcttataaaactataagtctttatttaaataaatctaaaatttcttcatttgttagctttgaaatattatttatatttaagctatcatcacttattacactattaattatttctctcttatcttcctgtaattttataatattttcttctatggtatcttttgcaattagtttaataacttcaactatatttttttgccctattctatgcgctctatcagtagcttggtcttcaattgcaggattccaccatggatccatatgcattacaaactttgcagatgttaagtttaatcctgttcctcctgcttttaatgaaattaaaaatacctgtggttcttcactttcattaaattcgttaactaatcttactctttcctttgcacctattgttccatcaagatatttactttcaattcttcttgcacttaattcttttcttagtttttttaatactgatgtaaattgtgaaaaaaccaatattttgtatttactttcaattacatcatcaattatatcaataactgtattaaatttcccatttttcccctcataattttcatctactagtgatggatcaagacatatctgtcttaatcttgttaagtaagaaaaaatagtaatcttatcctcttcaccatttttaatatttaacttaacatctttcatataacttttataagcaagtttttgctcaggtgtcatttgaacataatatttcttttcaattttttctggcaattcaaaaataacatctcttttcaatcttcttaatataaatggattaataagaagttttaattcttttagttcatcttcatctctattcataaatttttctttaaaagaactgtcatcaaataaatatcctggcattataaaatcaaaaattgaccataattcaataagagagttttcaataggagttcctgttaaagcaaatttaacttttgcatttatttccttaataaccttagtgttttgtgctttaggattttttatattttgtgcctcatctattatacaatagtcaaaaacttcattttcataaaaacttatatcattttttattgtgccataggttgtaagcaatacatcaaattcatttatgttaattaatattttttccctagcatttttacttccatgtactattcctacttttatatctggagcaaatttttcaaactcagccttccaattatataaaagtgatgtaggtgcaactataaggctttttttattattttcttgtaaatttttctcttctaatagaaatgaaataatttgtattgttttccctaatcccatttcatcagctaaaattccaccaaaccctaaattgcttaaggcctttaaataatttattccaactaactgataatttcttaattgacctttaaatcctttcacttggcttatttccgtctcattacgattagatagtttatctcctatagctttgactatttttttccctctaataaacgataaattatttccttcaatactattttctaaaaataaagctttatttttatctacttctaatattcctttacttaagtcttttctataagataaattatcaagcatagttaaaaaattattcataccaatatcttttaaattaattagcctactttttttacttttataatacttctttccatcttttaatgcctctaaaatatccttatactcactaaaatcaatatcctctatattaaatttaaagtataagttgtcctcttcaccttcaattatagcttctatattattcgaatttagtaaattagatttttcaaagcttttattaaaaattactttcgaaattaaagtaagctcatttattccttcacttaaaaattcatagtattcatcatcatttccaataaaaatataatatttatttttctttataaatcttaacctttcaagtcttctatcaatttcatcctctaaggttaaatctctaaagaactcaatactatcattttctaaaatatttatctctttgccaaaatagcttatggttgctttgcacttaactaattcattttctgtaaaaaaacttagcttaggattccaaaatcttctgcaaattctctttattccttctgataatacaacatcactactaatttcacttaaaacttttattacttttattaatttattactttcttttgaatattctatctttccttgttttttaagctctttccaaaattcaaaataagagtttgaaacactaatacttggtaaatatattttcctatcataaagaaaaacatcaaacttattacttaaaggtataggcagcttctttttagtagtaagattaacaatttcattttctaattttaaagtaaaagacagtggtaaattttctttatatacaaaagtttcataattaatataatcataatttaattttatttttttatcagtactaactaatgataagaactctctaatgtcattattttttaaccttaaatatttgccttcgattattttaatttcattattttctttaaatctatctattacaaataataaaagttgtttatccctttcagaaaaatacatattatatggattaaataaaaattccccattaatccttaactggcttttattttctatagcataaaaaaattcatttattttagtcactaagtaagtagtcccttcaccaattctaaattgaatatcaaacataaatatatttttttctttgatacttcttatatctaaatccaattttatttcttttttataattatctgaaatattttttttctttggtatgatattatcacttttattgcttttttttattttattcttagccactatataaaaggaaaatatgcttgctattatatgtttacaaacataattatttttgtattttgaaaattctttatacgtattacatgtacaagttgcaccatcaaccttttcatttttcaaattatattttatatgacaactatagcttttagaatcatcatcttcttttacctttgaatatatatgataaataccctcaatgcctttacttgtaattcctgttactaattttgacttataaatttctttaccttctttaatgctaatatttgatcctaaagccaatactgcatctaatagctttcttaagttcatattttcacctcgttatcttaaagtaataaattattataacatatcttacccttacagttaactctactcttactaattaaacttctaaattttatatctacctgtaaaatacttttatttttttgtgagtaatacaaggcataatttttcttacataaatattattactttctttcaagcataaaaagtacgaggtttataaaaacctcgtactttttaaatttaaggtggaaatttataaaattacaaattgctataaagcattgtaagattaactaatttataatttaagtttaaacttattatcttttaatttaacttcatttccattaaagaatacttttttactacaatcaaaattatgaaccataacttcaatttccttatagactttttcatatcctattttttccttcatttgtatatttaatgattctcctaactcaaagtcaaattcatacttattaaatttaccttctttataatcaaagctttccccatcatcaaagaaattattataatatccaataccttttttattagataagtaaatatttaaatttaaacattcgttatctttttcacctatataatttacatctttgctagttggtataattgacattgctttaatataaacaggacaaatatctaaaggtgcttctttaataatatattgccccccctcaaattctgttcctgtccaataatcaatccaactatttccttctgggagataaactaacttttgccttgatccttgttcaaccactggtgaaactaatatattatcaccaaataagaattcatcattaatttcatatgtctttttatcattttgataattatataataacggtcttataattggagctccattttcctcacatttgtacatcatatcatataaataaggaataaacttatatcttaatttaatatattttctattaatttcctctgtttcatttccaaatgcccatggttcctgctctctactaccaatagtagagtgattcctgaacaatggtgtaaatgcaccaacttgcacccatctacttaaaagttccgctgtacaatcatgtccaaagcctccaacatcagtcccacaaaaagccattccactaagccctaaattcattagcataggtaaagacattcttaaatgttcccatgtactttgattatcaccagtccaaactgtagcatatttttgcgtaccagcataacatgctctagttactacaaaaggtcttttacctgtaaattttttaatgccagtataagttgctttatccatcatatgtccataaatattatgaatttctttatgagtaactaatgtaccatcattatcaaaagttatatcgtcaggtaatggtccattaaagctagccggttcattcatatcattccaaattcctgcaactcctgaatcaatcattattttttgattatttgcccaccactttctaacatttgaattcataaagtctgggaaaacagaatctccgggccacacaacatttttatatactattccatctttatctgttgcaaaatatccattttttataccttcatcataaatcttatatcctttatctatctttacacctggatcaattattgttacaactttaaatcccattttctttaattgctctgtaaattccctaggatttttaaattttttattatcccatgtaaatactctaaaaccatccatataatcaatgtctaaataaattgtgtcacatggtatattcttttccctaaaagttttggcaatttctaaagcccgttctgccggtgcgtaagaccatctgcattgctgataccctaatgtccaaagttgtggtaatggtgttttacctgttaaattagtatattcatctacaaccttactaacttctggcccataaataaagtaataatccaaattcccatcctttgctccaaaatagtaataatttgaattttcttttcccatatcaaaatgactttcaaaatgattatcaaagaaaataccacatgcttctttatccttcattgtaattaaaaatggtatagatttatacaactgtgtataggtttctccatgtggcgttggatcatctgtattccaatttctataatgatatccttttttatttaatgatcctgttctttctcccaacccataaaagaacatatcattttccataacttttgatacatataccttgtactcttcgtgcccttccaatttatgtccttcttcagcagctaaagaaaactctgcccctaatcttctaaaaggttttctttcttccctaaagtctctacataatgcttctccatttaatttaaatatatcaactttaaaatcatcgtaaattctaatatctaataatttagtttttacatttaaacatccttcatttttttgtacactaaactcaatattttcacactttaaattttctactgctttcgaatttctttcttttctaaaaaatggagcaaaaaagtttactactgcttcattaatcatagtaacagtacattgaatatctttataatttactaatattaaatttttatttacttcataacttaatatttttccaaccatagtacctctatcccctttataacaattgaattattctatttaaatactactattatgatgttattatagtagttagaaatataaaatacttgcagcatactatcactaaataaaacaatactgctatactggagataatatggataaattagattttacaagactaaaagaaaatactactcatggaaattttattttaccattttctatatataaaggcactataagtccaacctttccttctattcctgttcattggcatgaagaaatagaagttattatagttatagacggaagctgtcattataggattgatttagattcatttataattaataaaggggatatattaattgtaggacctcaaagacttcattctttttctttaattcaagataatacaatgacttggatatcatttgtatttaatatggatatgcttaaaagtttaattactgatggtgcattacttaaatatatatcaccaattttaaatcataaacatgcacttcccaatttaataaacacacacacaccttgctataatgctctatttaacttaatagaaaatatagtatactgctactatgaaaaagatattgcatatgaacttgaattaaaatcatttttatttagtttctttgcgatcctttataaaaataatttaatagaacaacaaattaataagaacttattaaccgttaatactactgataaaattaaagcagtattaaattatattaatgaacattatactgaagatatttctattagcaccttagcagctctttgcaattatagtgaatatcactttatgagattttttaagaagaatataggtttaacttgtattcaatatataaataattatcgcttagaaaaagcatctattttacttacttcatgtaacaatgcaattatggatattgccttagaagtaggatttgataatttatcatattttaataaactatttaaaagaaaatataacttaacaccaaaggaatttagactattaaatagcaatttatcttaaaaaataaatgagatgtgtaattataatttacatatctcatttattttaatctacatattttaacgattcaactatttgaacacttttcaatttatagtacatttcaaaacttacaaacaatctaaatagacaccactacaaaactaattgtgtatttacttcttctagatggatttctcaattattcccaaattaacttatataaatattttacgtcatttattagattttaaaagatttttttgtctaagtaactaactttttatctttgaatatactaattaatataattatgaaataaggagtaacatatgtttatattttcttctattttgttagcattttcagcaagtttggacagcttaattattgggattgcttatggaataaaaaaaattagaatcaaatttagtataaatataataatagcattaatagttactttaggtacatttttatctatgcttcttggtgctatattaggcaaattcatccctgggtatatctgtaattatataggtgcaatacttttaattgcagtaggtatttggatgacaatagattattataaagatcaaaaatcactttgtagtgacacacctgatagtgatgatatagataatgatttaatagattctttaaattatgacgaaatattaactaaaaacaaaacagcagacatagatggttctggtaatatcgaattaaaagaagctgtttctctagcattagctttaagtataaataattttgcattaggtattggggcaagtatgtccggaatcagtattcctcttacaactgtttttacatttatatttagtgttttaattttaatagttggtttaaaaataggtaacagtttcctttctgaaatttttggtaaatactctggattattatctgcattaataataattttaatgggtattttccaactaattttctaacttttaaagtaattaataaaataattttaaagataaaaaagaaatattatatctacgaaaatcaagaaaattttccattgatatagtatttctttttttaatcttatcttaaattaaatatttatactaattctttttttatcattcttataatataacttattgtataaaaatctctatcaatttttgacttaattttatcaaatccttgaatcaattcactctcgctaaaattttctaataaaatcattaatgttaatgtgttaattccaccatctttagtatcaaatattcttgaatttttaacaaatttattttccatgaaaccttgtaaagcagtatttaattcagtgcttaactccattactggcatttcatcgaaaattcttacaccatctaattctttattgaaatttatagtcttttctaatttacatcctaaaaatattgtattttcgaatatggcttctttaaaatctgcaccatctaaatttgcaccctcaaaaatagcatttttgaattttgcatttttgaatttgctattttttaaattagttccaataaattctgttccttcaaaacttcccctaataaaactacaagttttaaaatgagcgcctctaaaagttgcaaaattaaaattagaatttgcaaaattgcaattatagcaattacttcttttaaagtttttatacataaagttcttatcttttttttctatattattataatgaaaattttcgcttccgctattgtcttttgccatctttttctcctcttactatatagtatatcctacaatcttatatacttttagaacaaaagtcaattatattttctatatttttcaaatgaatattaaattttatgtgagaaataataatatagatgtttattattgaaataatattaaggaggttttttttaattgaaaaaatttatttgtacaatatgtgggtacgttcatgaaggcgatacacccccagaagtctgtccagtatgtaaagcttcagctagtaaatttgaagaaatgaaaggtgatatggcttgggctgatgaacatagaattggcttagctgaagatgttgatccagaaattattgaaggcttaagagctaattttactggagaatgtacagaagttggtatgtacttagcaatgtcacgtgctgcagatcgtgaaggttatccagaagttgcagaagcatataaaagaattgcttatgaagaagctgatcatgctagtaaatttgcagaaatgttaggtgaagttgtttcaccaagcactaaagctaacttacaagcaagggtagaagctgaatttggtgcttgtgatggaaagaaaaaacttgctacattagcaaaacaacacaacttagatgctatccatgatacagttcacgaaatgtgtaaggatgaagcaagacatggaaaagcatttaaaggtttattagatagatattttaattaataatttattttaaggagatattaaaatggcaaaaattaattgtgatgtatgtaattgttcatataatagttcaggaatttgttgttcaaatcgtgttgatataggtggaatggcttcatctgctgaaaataatacatgttgtggatcattcttagataaaaaaaattatagtgaccttactaattcttcagaaacttcaggtccttgtgattgtttagtttgtaaagtaagtagttgtgagcataatgaaaattgtctttgtaccctttcttctattcaagtaaacggagctaacgcaaatctttatactgaaactaactgtggaagtttcgataaaaaataataatttaggcaaatgatatctataacttttatcatttgccttttatgtactttattctatttctctatttttttcattttcttctaaatcaataattaaatttttaatttcttgactatcaatactatcatcaattatttctttaaagtattcaatagcttcactatttctaccctgtcttaataattcataagcatattcttcaataattctattatcttccggttctaatgtatttgcttttattaaatactcctcaataaaatcatattttttcaaagctttataacatattgctaatgcaaaataattttcaccatcattattgtttatttctatagccttattaaaatacttaattgctttttcgaaatttttattattcgcttcatatatcccaagccctgtataagatctcccgcatttatcatttgctttgattgattctactaacgcttctttggctaattcactattatttaaatctattaaatatgtccatccaattatacatttaaagtttgcaatttgtatattatcacattcatatttttctatataatcaatacatctatttattgcatctatataaagcttttctctaatgtctaattcaactaaaaaagtattagctaaatattgttcttcttcttccattaaaactctctcaaagcatcttctactttcagcataaaggcctaactctaataaagcttctccttttacattatatccataaacaatataatcacaacctaattcaaatgctaaatctatagctgcaattgcctcctcaaagtatccttgaactaaataacaatgtccagtatatattaaatattctggattaccattctttttaaatccatcatttgcatatttcatagcttcttgaacattacaagctaaaatttcattaaatgtttcttcaatattttccatgatttcttcttccttatctaattatttatattaattatttttgccatattttacatagtttataattatgtaatattttatttttctttctttaaaaattataaaactaatatgcaacaaaaagctatcttttattatatattaaaagatagcttacaaattaattttatttaaattttaaattcagtatttttatcataggtatcagcttttagtaaatatctttttagtacctttgaagaaaatattttaaaattaagcgcggagtttatttcaatagtataatcattgtttttgatacactctttaagctctttaactgttttacattccttatttaaactagtatatattcctccaagttgaactggagtatgactatcactgccagttattatatttaaacctagctcttgagacaaattaattacttcatctcttgcaactgcctctccttttttaaatatatcctttccatttaaatctaatgcatcaagtctttttaataattcatgaggctgcttacataacttatgtcctcttctacatggatgtgcacctatttttagcaaattaaatacttctgctaaatccaataattcttctaaatcaattaagttttccttttctctaaaagcttcaagagacttatatatatttactatactttctctatcaccacaaagtatcacatgacctttgtttttcacacttacttccatagctggaaatactgaaataccctctacaatatatctatctccatcataagtataatttttttctaaaaaatcataaattactaaaaaatcttttgcattaaaatgctcacataaaactatagcatctaatccattatcctttgaaaagtatatctcattcatgaaaaaatctttattaaaatctttccgcttgcttaacaaaccatggacatgaaaatccacattcatttatttttcacaccctcaattaatttatacttttaaggtaaaataacctatattcattaatatattagtctgacttcttttatgttaattaatatgataaaatttttaataatttacttccttcatacaaagcccctttgctggtgcttttactgccagttcacttctttgtttagattcaagcatttttttaacctcttgaggttctatttctcccttagcaacctttaataatgttccacttaaaattctgaccatatttatcaaaaatccattgccgttatattctattttaataatattatctttttctgtaatatcaatataattaatagttctaacagtagacttttttgatttctcttttactgcactaaatcctttaaaatcatgagttccaacaagatatttactagcctctttcattttttcaatatttaattgtccctcaacatgatacgcatatttcttcataaaaacatttgcaaatttattattatcaacagtatatacataagtctttgaaattgcatttaatcttgaatgaaatctttcacttacctctcttaatgatataactgatatatcttctggtaaaaattcatgtaaatactttgacatatctttaatatttttatcactattagttttaaagtttgcagtatacttatctgcatgaactcctgtatctgttcttccacatccaattacttgaatgtcttctcccatcattttagatagaacattttcaatttttccttgaatagtagatacatctgttccttttatattttgtttttgccatcccttatatcttgatccatcatattgaattgtcattcttatatttctcatactttatctctcttttctttaaatttaaacatcagtctagttaacttcaattatctatctcttcttaagtttaaagccttctttgtagttaacaactttaacattaagtacatttaataatttttctaaacttttaacttgatttatatattcaatctttccactagcaagtaaagtattaatattatttataatatcttgtttttcagcctcccctaatcttctctttgttttaattacgcatctatttataaatgttagtgtttcccaaatttgttcatttgttattttactaaaatcatttattacccttgtatatccaactcgtctattcttaggaggatatgcttctttgaaaaattctaaaaaataatttatttctttaggatctttattatcaacaaattttcctaatgctgattttagttgattttttaaatacattatagtattcgcctttactattgtattcatttcttctatacttttatagattatagtatatatttcttgaattttatcactttctaaaccgtctttagctagaggttttactttttctattacttctaatatattctttttagaatttaattctttttcatatattttgctcaaaatttcttttcctgtcatatcttttaaattactctcttccatcttccgtttcctaccttaatttttttctttcatcaataaaatattgatatgatactataaacatagcatcatatcaatgtttattcttatattaatattttaattaactaatgtctatttctatttattagttctttattatactcttcatgcttttctattaattttccaatattttttcctttaatcatatcaattatcattggtgcaagtacagttagtgcatctctataaccaagttcaatatgctgatttaatacacttggtctaatattcaaagaaccaatcccctctataagctctaattgtgttgatggatatatttcaataatatttgtattttcaaaaccatttctattaagttcttccctataagacaaatgaactactataataatatcacaattatgctctttcagtggagcaattggaacattatctacattagattctttatattgtgggttatttaccccaccatcagcatatctatactcattaatttcaattggtttaaataaaaatggtactgcacacgatgctatacaaatatccaaggccttcttatcgtcataatcattaagcttaaaatattcaggttttcctaaatcaatattataagcacaagcatataatatctttttactttgcctaatcaaattaaaatcaacataatcttcaataaagctttttataccactctgtgataataacccaatatcattttttttaaataagtcagctaactttttttctttatctatagtaccatctcttttaattaattttcttatattaatatctcttattttattttcattattaataaatcttgagtaagaaatattagaccaacttttatccataacatttccatcgttcatagaaagcataagaccattaattgtacctattgatgtacctgaaactacactaacccttcttattatatccaattcccagagtgctttaaagactccagcttcatatgcccccttagccccacctccagctaaaactaatccaatatttaaatcaaataatttttcaacatctatcaccttagctcatcatccttcatcctaatactaattgtataccttataataattccttatataagttcattatattcttaaaaaatatcttttctacttcttcataagtaaaaccattttttaatagtgactctgctaacaattgaatttgtgacgcatctttaatttctaaagtactttgtattccatcaaaatccgttcctaatgcaataacatctattccgcctacatttttaatatgcttaatatgttttaccaaatcctctatataagtaaatgttaaacctgtataaggtgttggcataacaaaacttgaacaaaagttaatccccgtaactccacctttattagctaacttctttatcatatcatcagttaaatttctaacaacatttgtaacggctcttgcattactatgacttgctacaaatggttttttactatattttaaaacatcataaaatccagcatctgacaaatgtgatacatccactataatccctaatctctccatctctcttaacaattcaactccaaaggctgtaagcccaaattcagtattaggagttataaaatctggtttttcagttatatttccgcatgtatcaatcttaaatttaaaatttggaaaacctactccatttatatgattccatgttaatgttataagcctgaccccctgctcataaacagtttttaaatttgttaaagaaccttctaatgctcctgcatcttctatagttaataatgcacctatttttttttcattagtacaactatctatatcttcataagaataaactggcttaattatatctctattttcctctaactcttcatgataaacttgtatcatctcttgcaaagttttataaggatttttatatttttctatatctataaacattgcaaaattttgaagtagatagtcgccttttattagtttatttaaatctacatgtaaattactttcttttaaactatactttttccctaagagtctattttcatatatttctcctatcgtatcacaatgcatatcaataactttcatttccattcccctccaactttatcactaccttaattatatcatatataacttcatatgaaaaaagcagcatccccattccctaataacttataaaatacaataaccattaaattgattttatatttttataataacaaaaaaagttgttacatccgtaagaatgtaacaacttctacctttatattaagctaatttctcatttattatttccataactttttcgttaaatctctttaacttttcttcagcattaattaaactttcacctttaacagctgaataaaccttcattttcggttctgtacctgaaggtctaactacaaatgatgaaccatcaactaaaatatattttaatacatttgattttggtaagttaataactttttcagaatcatttactaaatcctcttctttgcttaatttataatcaagtcttttagcaattttaacaccatcaacttctgttaaagctgtttctcttaataaatctaagcacttacctattttttcttgaccttcttttccttgtaactcaattgaaattaagtcttctttgaagaatccaactctattgtaaagttcaattaatgcttcatataaagattttccttgctctttatagtaaagtgtcatttcagctattaacattgaagctataacagcatctttatctctaacaaactctccagctaaatatccataactttcttcaaatccaaataagtatttcttatccccattttcttggaattgtcttattttttctccaatatatttgaatccagttaatacatccattatttcaacaccatagtagttagctatagctcttgcaccttcagaagttacaatagtcttaataacaacaccatttgaaggtaatttaccttcttccttaagagatgataatatataatctgttaataataaacctgtttggttacctgttaatactttatattctccattattttccttaacaacaacaccaattctatcacaatctgggtcagtaccaaatattatatctgggttgcttgttttagccatttctaaagctaattcaaatacttgagcattttctggatttggataagaagcagttgggaaattaccatctggcatttcttgttctttaacaacttctacattttcatatcctaactcttttaatactcttcttacaggcatgttaccacttccatgaattggagtgtaaataacctttaaatctttagctttttcttttactaattctgttctaattgtaagatcttttacttcttcaagataagccttgtctacatcttcacctatatattctaaaatattgtcttttaatgcatcttctaaagcaatattttttatatcttcataatttactatattattaacttctccaattattaatcctgctttttcatcagtaacttgaccaccgaattcatcataaaccttatatccattatatattttaggattatgtgaagcagtaattactattccaccttgacaatttaagtgtcttactgtaaatgaaagcattggtgttggtcttaagctttcaaataaaaatacctttatattatttgcacaaagtgttaacgctgcagcttcagcaaattcctttgacatatttcttgaatcatatgcaattgcaacctttggagattcgaaacttttatttaaatagttagcaaatccttgagttgcctttgatactgtataaacattcattctgttactcccagcacctataacccctctaagaccacctgtaccaaaatctaactctttgtagaatctatcttctatttccttttcatctgtaatgtttcttaattcagattttattgtttctgatattacctttgagtttaaccactcattatacttctctttgtaatccatattatccctcctaaacattttcagtagtctataccttagttattatataccaaatttatataaatttaaataaaaaaataagagttatatttaaaattatttataactcttatttttagtatattttttattccgcaacgtcttttatatcagcatcttctacttcttccatatccttgctaactgtattacgttcataactaatagatgcaattactgaatttaaatcatctaatactgatatttctgatgctacttctaaatctccaaatttataaactgatccaacattccctgtacctatattaaaatctatatatttaggtattgaatcaacagtacattcaactttcacgctatctttttccttttgtaatacaatacccttcttatttaggaattcttctcctatgtaatgaattggaactgacgaaacaaccttttcagttccatttacttcttctagatctaaatggataattttatttgttacaggatctttttgaacttctttaattaatcccttatgtttttctccatctaaacaaaaatcaaggactccatgttgcccattttttcctatttcatgagctaattcaagctctccaacttcaaatgataaattttttattgctttaccatataaaactcctggaacctttccgttttttcttgctttctttgcactatttggaacatctatagatcttttactaatttctaaatctgacatttcacattacctcctgttttttaaactctcttaggtattcttaccaaagaatttataatttatacatttaagttgttaaattatgtgtttttttattttatctacattaatttaataatttttacgaaactttaaactaaatacaatcatcaataataaaaactacatttatatatatttttatatatttatatatatttttatatatttttttcacattaatgcatataataatattatttaaattattatttgtagctttatatgctatagctatttatatagctgctatagacaaatgtttattttatggtagaattatgtggtggtatactaaataattaacaaaggaagtgattattatagtaatacagcatgaaaaaatttcataaaagcgccagaacttaagtgaaactcgaattttatttctgcaagctgaacttactcagactaagcttagtttgctgaataaaaaggaaactcctactaccataggagtaagttcgcctaaccaaatcgaagatttggaggctcacttaagttgacgaggatggggagtatcgaattcttcggcgggtgccccacggtatcgcactaccgttaacaactagtaaaactacaaagtgatttgtagcacaatcctagtttggtgttaaaaccttcattgtgtttttagaggtcctagtattggtataccatttttaatacttttctttaatatcacaataaaatcaaataaaaaaaataattattaaatggaaggaagatttatttatatgtgcggaatagttggttatgtaggaaatagacaagcgtctaatttattagtagaaggattatcaaaattagaatatagaggatatgattctgctggagttgcaattttaaatgatggaattaatgttagaaaatttaaaggacgtttaaataacttagcaataagcctaaatgaaaatcctatacacggtcatattggaattggccatacaagatgggctactcatggtgaaccatcagatgttaattcacatcctcatactacagaaaatgctacaattagtgtagttcacaatggtattatagaaaactatatgaaattaagagaatggttaacttcaaaaggatataagttcttttctgaaacagatacagaagttataccaaatttagttgactactactatgaaggtgatttatttgaagctgttgttaaagcaacttctaaacttgaaggaagttttgcaattggagtaatagctaaaaatgaacctgataaaatagttgccgttagaaaagatagccctcttatagttggtttaggaaaagatgaaagctttattgcttcagatatccctgctgtattaaaccatacaagagaagtttatttattagaagataaagagtttgctattttaacatcaaatggtgttcaattaagaaacgaagatggtgaaaaaattgaaaaagaaatttaccatgttacttggaacatcgatgcagctgaaaaaggtggatttgaagatttcatgttaaaggaaattcatgaacaaccaaaagctgttaaagatactttagcaggtaaaatcgccttaggaaaagaaataacaatagataatatatcatttacaaaggaagagttagaaaactttgatagaatttatgtaattgcttgtggaactgcttaccatgctggtttagttggtaaaacagtaattgaaaaattcgctaaaatcccagtagaagttgatatagcatctgaatttagatatagagatccaatgataacagataaaacattaataatagttgtatctcaatctggtgaaactgcagatactttagcagttttaagagatggtaaaaaacaaggcgctagagtcttagctataactaatgttgtaggttcatctgtatcaagagaagctgatgatgtattttatacattagctggtcctgaaatagctgttgcttcaacaaaagcttatgttactcaattagcagcattttatatcttaggattatactttgcttcattaaaaggtactatgtcatatgaagaaattgaagaaattaagacacatttattagaaataccaaataaaatagagaaagcattaggaatgaaagattctcttcaaaaatttgcttcttctcactataaccataaagatatgtacttcttaggaagaggtcttgactacgcagttgcaatggaaggctcattaaaacttaaagaaatatcttatattcactgtgatgcttatgctggtggtgagttaaagcatggtcctatagctttaatagaaaaaaatactgcagttattactcttttaactcaagaaggattaaaagataaaatgattagtaacgttagagaagtttctacaagaggtggaaatatatttgcagttgtaaatgagggtgatactactactaaggaagttgttgatgacttagtttatataccaaaaactattgatatgttaactccactagtaagtgttgtaccactacaattaatttcttattatgttgcaaaacaaaaaggttgtgacgttgataagccaagaaatcttgcaaaatctgttacagttgaataataaaaaaggatacacattttgtgtatcctttttttaattaaacaattctttaatttcttcagaacttaaactacttaagaagccaccattagtataatttccattcattatatcattaataatttctttcttactttcttgtagtttaattatcttttcttcaatacttccctttgcaataagcttaataacttctacaacattcttttgcccaaatctatgcgctctatccgttgcttgatcttcaatagctggattccaccatggatcaaagtgaataacaacgtctgcagatgttaaattcaatcctgttcctccagcttttaatgatattaaaaacaccttaactttgcttgaattattaaattcatttacaagttgaactctctctgaagcttttgtatttccatctaaatagaaatactcaatcccttctgcctcaaaaatattttttatactatcaagtacagatgtaaattgggagaataataatattttatgattattatttataaattcatttattaattctacagttatatcaatcttaccgcttccaccagtatatccttcaagaagtatgcttggatctaaggcaagttgtctaagcttagttaaataagagaatattgtaatcttatctttagctacatccttttcttccatttttactttaatatcatctacataagatttatataccttcttttgctccttagtcatttctattacgtatcttttctcaattttatcaggcaactcgctcataacatgattttttaaccttctaagtataaatggcttaataagcttctttaattcagatttccctttttccattttaataaatttatcttgaaattttctttttgaatataagtatccaggcataatataatcaaataacgaccataattctaaaaggttattttcaattggagttcctgttaatgcaaattttaccttagcatttaattctttaacaacttcactactttgagataaaggatttttaatattttgagcctcatcaattatacagtaatcaaagttaatttctttatataaattgtaatcatttcttaatgttccataagttgttattaacacatcatactcattaatttcttctcttataaacatcctttcttccttactcccatgaattatcttaatcttcaaagaaggtgcaaatttttcaaattcacttttccaattataaattaatgatgttggagttattatgatactcttctttcctacttctgataataaaaatgtaatagtttgaagtgtttttcctaatcccatctcatctgctaaaattccaccaaattcataataacttaaggttttaaaccacttaaatcccgttaattgatagtctctaagagttgctcttaattcttttggtacttcataattgacactatttaaattttctattttgttagaaatatgttctactatatccttcccatgtacaaacaataaattgttttcttttatactattattaataaataatgctttgcttttatgcaccttaatttcattggattcaataagtgattcctcacttaagttatcaataagatcaaacaatttgcttacttcttcgtcttttaaatcaacaaaactttcatcttttaacttaaaaaaccttctattctctttaaaagcagcaattattttcttatattcatcttcactaacattttctatactaaatgaaaattctaaataattacctcttccttctgtaatagatgcattcaatgatgaagctccataaattcttctttccttgaatctatcagaataatatacagtagctttctcttttaatattgataaatcatctgaaagtaagtcaaataatttttcatcatccccattaaacataaatacatctttacttctataaaaagaaaatctatttaatatcttctctatctcttcttcttcatttaaatctctaataacatactggtcatctttttgtccctttatcatattaaaatctatgtgaccataataaactttaactaaagcccagtttttctttctatctctatctaaatatatttcgaatcttggtttttctttaactatactttttttaagactctcatctatatttatttcctcacttatagtttctaataaaggtaaaaccttattaaagacttccttttttttattatctttaaatgtaattacaggctcttttgtaaatatatcatttatagttttataatattttacttgattttcattaggtaaataaatattattctcataaaggtatacatcgcctttatcatttagtggctttggcatttcttcattagaagaaattttaatttgcccattttcttcatttatattaaactttatcggtaagtcttcgttaaacacttgtaatttaactgtagtaatatctttagttaaagttattactttatcccctatattgcttaatagtctccttaaagcgctttgaggtataaataaagtcttattatttccaaacacactgttagttatcctattaaccgaatactctttttcaaaaggttcatttaacgatacatattcttctataaaattcaaaatattttcatcttcctctgaaaaataatatattgatggatcatacttgaattcttttccatatgataatgttttattaaatctcctagcattaattaattctgctatatttttaacaacataatattttttagttcctattttcaaatctaattcataaaaatatttatattttgttatatccctcttagttaaatttacttgtatgctagctttttctttatcacagttattaattttatttataacgctaagtaatttatctgaataatccccattatcactatctacgctacttattttctctttttttgcatttgttttttcttcaattgcttcttcaaacttataaaacgtagcacctatatgcttacatatatatgtagaattaaaatcacaattattttcaaaatctacgcaattacattcagtataaattaactcattcttttttaaatcaaatgataaatttgtattataaacatttaagtcactttcagatatgacttttccatatatatccaaagatccatattctttatctgctatagactttatatccagtactaatccttctttaaaacatttcatccccttataaagacgattattactatctttttttaatattaatgcgtttagttgcgtcacattcaccctaagtcacctcattaaatgaactattttatatattaactttatttagagtttatttttttattattctaaaaaagcactatcaattattttaccacatttttcactaagtaatacattattttaacaaaaaaagaatgtatcaaaatatatttactttgatacattccataaatttaaattatttctttgtatgtttcctctttaaatcctactaatactttttcttcagttactaataatggtctcttcacaagttttccatcacttgctaaaagcttaatcatttcttcttgactcatatcttttaacttatcttttaggttcatttctcgatataaaacacctgaagtattaaagaattttttaatttctaatccacttaattttatccatttatctaattcttcttcagtaggattatttaatactatatctctatcttcaaaatccacattattttctgttaaaaacttctttgcttttctacaagttgtacatttaggatattcaataaataattttttcataagtatctccccttttcattttttatattttatcacacttacaatataatagtaaataatagtataaattttatatttctatttatgattaatattatataattgtatataatatatatattacaattattatttctaataaaaggagttgatatcttggaaaattcacttaacaaaaatgattccctatttagcattatcaataaattaataaataatagaaattacatagaagctgaaaatatattgaactctacaaaagataggaattcagaatatcattatctatatggtctaattttaaagaataaagcttggtttgatgaagccttatctcacttaaaaaatgcagtaatattatcaccagataatatccaatacaaagatgaacttatttcacttatgagcagacatagacattactcagatgattactataataacggttatagaagaagaaaccgtggttgttcttgttgctgttgtgatgattgttgtgattgtggcaattttagttgttgcgatcttatttgtttagatcaatgctgtgaatgtatgggtggagacttaatagattgtatttaatattatttctattattttattgaatcacttatttacatcaagatgaatatattataatgatttaataatctttctaaggagatttaatatgaacccttataaggtactaggtgtacgacctaatgcatctttagatgaaatcaaaacagcctacgaatcccttgcaaatacctatgatataaatagttatgaaggttctttagaagaaccccttgctgaggataagctttcagagttaaatacagcatataatagtttaattaatgagtataagtacaaagatatacgtaatttaattgaaaaacaacaatttttatcagctgaaacacaattaaatttaattactgataagtcatctgctgaatggaactatttacaaggctttgttttattaaaaaaaggttggtttaaggcaggtgttaatcatatgaaagctgctgcagaacttaaccctgataaccaagaatatcaagaggcattaatggttttagctaaaaaggtaaaacaaatgaaagcaaactatgctcgtgctatgcaaagcaatgcagctgcacaaaataataatagcatgtgtggcggtggtggcggaaatcaagcaaatatgtgcggcggacaaggttctggtggaggaattgatccaaatatattaaatatgttaatgaataattctggtggtatgggcggtgctaatcctatgagtggaggagctaataatatgggtggtgcagctaatggtgctaatcctatgggtggagcaaacaaccctttaagtaatatggctggcatgggtaataatatgggtggcaatccaatgcaaaatatgctattgcaaagccttttaggcggcggtggcaatggaatgaatatgtgtggtaatggcggtggtggtggattgtgttaaaacatcacttaatcttcctaaattatctatgaagctaaaaggagtcttataatgtttggatacgtcacacctcttaaaagcgaacttaaagttaaagaatttgagtactttaggagctattattgtggcttatgcaacgaaatcaaaaatcaatttggtaatataccccgattttgcttaaattacgatttaactttcattggttttatgttagatggactttttagtaatcctctaaaattaaaagaggtaacatgtatacgccatcctggtaaaaaacttattattgctactgaatcccaatgtttaaattattgtgcagacttaagcatattactatttgattataaacttaaagataacatagaagatgacaaaagtttaaaaagtaagttttttaaattaattctttctccttcatctaaaaagagctttaacaatttaaataagatagctgataaaatatcaactaatttaagcctaatttctaattttgaaaagacaaaagccttttcttcattagatgaaatatctcatccctttggaaatattatggcatgtattttaagtgatttcccatatgaatttgaagaagatagtaaaatactaagagatgcattatattcacttgggtattttatcggtaaatggatttatttaatggatgctttagatgatttaaaaaatgatatatctacaaatagttttaatccttataatgttttatataatactaaaaatttatcttacgaagatttactatcttcttgcattgaagatattgacttttctattttaaatagtttagttaattgtagtgaaactttaaaaaacattccttttaaaaaacattatactattattgacaatgttattaatcttggaatgctaaacaaatattatgaggtattaaataaatatcattttattaataacaaaaagataaataccagtagttagctactggtatttttttgtattatttattgtaagctacaatatctcttttactatcagctattacattgccatctttatctaagtcatatattgatgttactgtaactttttttatgtcaccttttaaatcttgaattttagctataaaataacttttcactcttttatttatttcttgtggttcttctacttcacttgtaaaagtaccttcagtagtttctacaataatttgtgttttgtcattttctgttccaaatgtatacgaattgctcgtatcattatataaatctacacgaattagagctccatcaaataaaactgcttctttcattaaatttaaattcaattctttttctttattagcaggaacattaaagtttatacattcacttattccatctggtgaaattgaccatccattatcttccttaattaatgcataaacataatcttcattgctttcttcaccattgattactgcattaatattaactactgctttttttaaattttcattaatatcctctacactttttgtagttgatgaattaatagttgcatcttttctgttacttttaatcatctttattattttgttcgcatcatatcctatgtaatctatatattcatcggaatatagtttaaccatctcttcaatattattttctacgttatacttattgaatgattctaatacctcttctgctgtgttacctctaatcatttccacttctttaccgcaacctgtaagcaaaatagacataatagaaataacacataataatgttaataatcttttaattcttttcatgaaaacttcctcacttttctaatttctctcactaagtatacaacatgttgtaggaaatttcactaataattacataacttactttgtaaattttttaacttctttaaatgattatcataatctttaactacaccataaatatcacttaaaatactcttttccatactttcattttcctcaataaatttatttgcatttctatttccgatttccattgcttttattgcatgctcacatacttcacaatcggtatctacgggaataagcttaatcttttcaaaggcttctgctatgtttcctcttatccctaatgaatcactagcatttcctcctaattcttctatcctatgcgtaattgcttcttcatgctttttaaaagattctattatttcctttaatacacccttcagctctaaattttcagccttatctaaatactctttaaaagtagctcctcccatatgaacccctgttaagaatttatttaattcttttataatcttatctctcactttttatcacctctatactttttacattattttttccattatgaaaaatattatttatctaccaccgaaaaaattttttattaataattacaaaaaggatatacatttctgcatacccttttacattaatctaaatcacgtatataaaatcctttattatatacttctttatcatatttaatttcaagcttattacaagctctaacatcttttttattaactacaaactttattccactaattataatttcttcatcttcatcgcttttaaaatctggatataaatcatatcctggtcttccacatccataaaatacttttattctcacataatcttctgaactattttctataagttcacttaatgcatttttggctttttcatcaaaagtaaattccattttacttcctcctaagtatttttatagtaatataaccttactttgcagtacctaaattaaattcattatgaagcaactttatagcttctcttaccttactagtgtaaattaaacaccatattgtcatattagaatctgttgtttgtaaaatttcaatctcattgctagttaaagtatttattattcttgccattacacctggaacaccattcataccagctccaactatagcaatagtactacaatcttcaattatagtatattttatttcagcttttttcattatttcatcaagcttttctttttcagacgcatctattgtaaacatttgatgttctgggaaaatattaattaaatctaggcttatatggtttttagcaagcaattctaataaatttttatacgaacctttatctctattatctgataatcttactctaacttgaattctattatttaagtgagtaattccagaaatcaatctcttttcttcttcagaaacactactttttatcactgttcctttacaatcattcattgtatttttaataactaatggtacatttccctttttagctaatgctacagccttaggatgtattacttttgcaccatgatcagctaattgaaatacttcattgtaagaaatttcatttattagtgaagcatcttcgacaacccttggatcagctgtcataattccatctacatcagtatatatatcaatttcctttgcttttaaagcaacacctaatatacatgctgaagtatcacttccacctcttcctaacgttgtgaaaaatccatcttctgttacaccttgaaatcctgtaataactggtactttcccagcttctagtattttcattatattagtattatcaactttaattgattgagcatcagtaaaattatcatccgttattattccagcttgacctcctgttaaaggaacagcagttattccgtgcttatataaatcattgcacattactacagagcttattatttctccacagcacattaataaatcctgagcgcttttattattctctttaaaattactatctacaagtgataataggctatctgtagcatagggttctccaaaccttcccattgctgacacaactactactggtttaaaaccactttcaattgctttgcctattttttttattacttgttttcttctttcctctgttgatacagatgttcctccaaacttttgcactataatatccaaggaatcttcccccttaagttttctaagctctcgctctctttatctttccttcctcggcagagattactatgacattagttcctactttagttacacattcccatggtatttcaacgtactctttactaccaaagaagctaaactttcctgcactaataccaaccaccaggaatttaagatatccgttttcatctattacaaagtcaatatttgaagcagtatcatatttttctgcactttcaagattaaaaatttcataaccttctaattcacttaaatttcttatcttgctctctggttttttttcataatattcaaaatccttcataataattacctccttgttatacataatattatgcatccctttggtaatatattactttaagaattagaacatcaaaccttcaaatacttactttacataactaatatatcaactatatttagaacttacaataaaaacttttcatcagtactgttcttatatgcaactttagacttttctaaaattgtatttaatttatcagcttcaacaccttgcccaacaaaagctgtactgattattcctggtttaaagcatctctccaatacatagtttatgtcatttttgtctattttgttaattctattaataacctcttcttgagtttttatcttattttgtaataaaaagcattttgcattagcaaacattcttgatgatgtactttctaatcctaaaatataatttgcctttattttctctttgtttatttctaacaattcattactaataccttctctagtaaacttttctaactgttcattgattacacttattgctttatcacaatatttattgcttaatccagtgtaaatattcattgttccaacccctaaataaggttgcatatatgaataaattgtataacataaacctaattcttctcttactttttggaaaagaatcgatgatgctccaccaccaaaaatattgtttaataatactaatgaataagatttatcattagcgtatggcaagccattaagtccaagattaatatggacttgttcaatttgcttttcacaatatttactatcatttttaagtataatttcctcatacgttggtttataaatatcatccttactccatccaccaaaatattcttcaataagttttctcaattctttttcatcaaatcttccacatatactaagtacagagttatatggtgtataatgagttctaatataatcttttattttttttctattaaaagatctaattttatctggagtacctaaaataggatatgctaatgaatcatttccaaagatagcttgagaatgtatttcatctaatacatcttcaggattatcttgactcatattaatttcttcaattactacacctttttccttttcaatctcttcttcatcaaatttagaatttaataacatatctgaaattacttctagacataagtctgtatgagtatttaaagcttttatataataacaagtagtttccttacttgtataagcatttatttgtcctccaatattctcaatttcttgaactatttcttttgcacttctcttttctgtacccttaaagaacatatgctcaataaagtgtgatataccattctcatcttttgtttcatttctagaaccattttgaaccataatacctacacttatagaatttacatgttcaatatattcagtaactactcttagcccgttatctaatgtatataaattaaacatacttacctccatttttataagtttgcttttagtttattttaatcttatcatatttattctatatagtaaaaaaaagagaattatttttaattctcttttaccatttcaattattcagttacttcatctggtggaagcgcatcttttcttgaaagatttattcttccttgtgaatctatttcagtgaccttaactaaaatctcatctccaacagatacaacatcttcaactttttctactctctttttatcaagtttagaaatatgacaaagtccttctttattaggtagtatttctataaatgctccaaatgcagctatcttagtaactttacctaaataaacttcacctgcttcaacttccttagttaagccttcaatgattcttattgcttcatttactccatcatgatctggagaagaaacaaatactgtaccatcttctttaatatcaattttaacgccagtatcagctattattttattaataacttttccaccagctccgataacatctctaatcttttctggatcaattgaaatagtagatgtctttggtgcaaacttagaaacttcttgttttggttgtggaatacattcattgatcttatctaaaatgtgtaatcttgcttttcttgcatttttaattgccgtttcaataacgttaaagcttaatcctttaattttagtatcaacttgtatagaagttataccttcagtagttccagctaccttaaagtccatatctccaaagaagtcttctatgccttgaatatcagttaaaacttcttcttcacttaaatcttctgatgttataagtcccattgcaatacctgctgctggcctctttattggaacacctgcatctaataatgctaatgtagatccacaaaccgaagcttgagacgtagaaccatttgaacttaatacttctgaaactaatctaatagtatatgggaattcttcttctgaaggaataagtggttctaaagctctttctgctaaagctccatgacctatttctcttctaccaggtcctcttaatggtcttacttcaccaacagaataagctgggaaattgtagtgatgcatatatctcttagattctgtttcacctataccatctataatttgaatatctccaactgctcctaaagtagcaactgtcataacttgagttaatcctcttgtaaataaacctgttccatgagttcttggtaataagtcaacttcacaagttatttttcttatttcatcgaatgctcttccatcaggtcttctagagtgatttaaaagcatatctctaactacttctttttgcatgttatatattatttctttagaatctccaaagttatctggatacttttcagcaaactcttcagtaattttatcgtttactacatccatagctgcatttctttcatctttatcagtaatccacatagcttctttaatcatttcacctgcaaattcttctatatcctttgcaagctcttcatttggtttatataaaactggttcatcctttttcttaccaaacttagccattgcttcttcttggaaactaacaatttcttggcatttttcaaaaccatattcaattgcgcctatcattatatcttcaggaatttcatctccacctgcttcaatcatcataactctgtcttttgttgcacaaacagttaattgaagaatactttcttctctttctttagatgttggatttaaaatgtaattaccatcgattaaacctacttgcactgctgcaactggtgtagtgaaaggaatacttgaaatagataatgccattgatgctgcattaattgctagaatttctggtaagttatcttgttctactgatacaactgtacaaaccacttgaacatcatttctatatccttttgggaataaaggtcttaatggtctatctacagctcttccgaaaagaattgcgttttctgaaggtctaccctctctttttataaatccgcctggtattttacctacagcatataatctttcttcatattcaacacttaatgggaagaaatcaatcccatctcttggtttttctgaagcattaacattagttaaaataactgtatctccatagctcataaaaatagctgcatttgataacattccaactctaccaaattcaactttcatagttctaccagctatatttttttctagtacattagtcatttaataacctcccttcaggttttgcggttcttcaatttaatttttttaaaataatagagcggataaaacccgctctataaagactatcttcttaagcctaattgtgctattatagctctgtatctttcgatatcttgtgcagctaagtagtttaaaagacctcttctttgtccaaccatcattaaaagacctcttcttgagtggtgatcttttttgtgaactcttaaatgtccagttaatgagttgattctttcagttaaaagagcgatttgaacttctggtgaaccagtgtctccttcgtgtcttccgtattgtttgattaattcttgctttcttattgcgtccataatgacacctccagtaattttatcccctatttccaggaaaagagaaatcaccctcaaatcttagaagtaggttcttcatgaaatattatagcaaagtccgtctatcttgtaaacataatttattattttaaatatatttagattttattatctaataacatagatttataattttttttgacacattgctatatttctttcttcagcatatttcttatctttttttaattgagttattaactcttcaatattattaaattttacttcatctctaattctatcaatgaagtaaacattaatttcttttccataaatatcaccgttaaagtctaaaatgtaggtttctattgttaagtctatcccattaactgtaggattattccctatagatgtaattcccttaaaaaatttcccatttatctctacatttgtataataaacaccttttttaggaataattttttcgcctttaacttccaaattagctgttggaaatcctattgttcttcccaatttcttaccatctacaacttttcctgatagcatatatggtctagatagcatattaaatgctttatatacatttccttgcagtaattcatttctaatagctgttgaactgataatctcatcttttatcatacatggttccataatatataatttgtaatcatatttatcttgaagtttctctaaaagttcaacatttcccaaatttttatatccaaatttaaaattaaatccaacaacaatccctttaaccttataataatcacaaagccattttataaattgctctggcatcattttcataacttcatcgtcaaagtctttaaatgctagtatatctatgtctttttcctctaaaaccttaatcttttcatcattactcattattaattgaacatggcaattaggattaacaaaaattctaggatgattcttaaaagtaaaaactatagctctaccattattttcttgagctaaactttttactttttctattaaagataaatgccctaaatgtaatccatcaaaactacctaaagctatataattatttttttcttcatttttaagagtgttattatcatatattagcattaattttttctcctatgtgattagtaacttctctattttaaagcctaaatcatttttcttaccaaggcctataaaattattttcctcatcatatactctatataacttttcatttataactttatttttagtaaatctattatctccaactctaactccgttaattagtaaattaacatattttccatgaacaataattttatcatacttttctagagctttttccatagataatatatattgatttatattttcttttgttaaatcatttatattaattgattcctcttgtgaaaacacagatgttttagctctatttaactctgtcatagttgcaaaaacccctagcttttcacctatatcatagcataaactccttatgtaagtacctttagaacaactaaccttcattgaaacataaggattgttaattttaatatcttctatattataaatagtaattaatcttccttctctttcaacttctatgccctttctcgctaactcataaagcctaactccattttgttttaaagcagaatacataggtggaatttgtgaatattcgcctataaaactattaacagcttgaagtatttcaacatctgttaaatgttcgcagtctctttcttctaatatttcaccttctaaatcataagtagttgtcctaattcctaactttaaagttacttcgtatactttttcagaattcataatataatctattattttagttgctttccctatacagattggcaatactccagttgcttctggatctaatgttcctgtatgaccaactttacctgtgcctgcaactttttttactactcttacagcatcaaaagatgacattcctttaggtttaaaaatatttaaaacaccattcatctcttacaactctttctgtatttcatttaatatttcatatttagcttcttccattgatatatttttaatttttatacctgaagctcttacatggccaccaccaccaaaaatttcagctatttttcttacatcaacgtagctctttgctcttaaacttgctttaactccatcttcaacttctttaagtaataacgttacttctacacctttaatttgaagtccatatgaaattatatcagatgtatcacctacatctattcccaaatctgctgtaaaatctttatcaatttctaacaatgcaacttttccatttaatataagttgcatactacttaaagcttttccaactaattttattctactaaaatctttattatcaaaaaggttctgatatatgcttgtattatcaacacctatcttttttaaagcagcagatattgtatgagttcgttcagtaacattagaatgtctaaatgcacctgtatctgttactattgaagtatatatgcatgttcctatctcctttaaaacactgctgttttcatcattaaaagaaatccccatatatcctaataattcaaatactatttctgcagttgctgcagcttttgaatctatataattaatatctccatatttatcatttgaaagatgatgatctatatttataattgtaccagtgaattcatttaaatttgcacttactctctctaaatttccacagtctaatactactactatatctgtatcatttgtagcttctacaatttctccaacaatttcttcagatccttttaaaaatttcaaattatctgacaaactatcctttgagattacatagcaatttttgtttaaactttttaatccattaagaagtgcaaggacactacctacagcatcaccatcaggtgatacatggtaggtaatgcctatttttttgccccttaaaatatattctgcaatttgacttaaagtcatattacttttcttttaccttttgaattaattcttcaatatgcattccataattaattgaatcatcaagttcaaatataatttgaggattatatcttaaattaattctttgacctatttcttttcttatatatccactagcattttttaaagcaacaaaagtgttgttcttttcttcatcatcttttccaaaaatacttacaaatacttttgcatatcttaaatcctttgttactttaacatcagtaactgataccatagcagtaagtctaggatctttgatttcattttgtattatattactaatttctctttttacttcttcgtttattcttccacctctatagttagccatttaaaacacctcttaaagctcttttcttttaatagcttccattgtaaatgattctataatatcgccttctttaaggtcgttgaacttttcaacgcttaaaccacattcatatcctctagcaacttccttagcatcatctttaaatctctttaatgaagctaatgttgattcaaatataactataccatctctgataactctaatttcagaatttctaacaatttttccatcaataacataacatccagctatagtaccaacatttgaaatcttataagtcattcttacttcggctttaccatttacaacttctttatattctggctcaagcataccaatcatagcagatttaacatcttcaattgcatcatagataattctatatgtctttatctcgataccttctttttctgcttgaactgtagcctttccatctggtcttacattaaatccaattactaatgcatttgaagcagcagcaagtgtaacatcagtttctgttattgctccaacagcaccatgaataactcttactttaacatcatcagtagataacttttctaatgattgtcttattgcttcaactgaaccttgaacgtcagctttaacaactattgctaattctttaactttaccttcttggatttggctatataaatcttctaaagatactctgtttgatgcttgatgactatcagctttgattttttgttttcttaattcagccatatttcttgctgttttttcatctttacaaacaataaatctatctcccgcagatggaacttcagaaagacctaatatttcaactggaatagatggtccagcactcttaattttcttacctttatcatcaaacatagctctaattctaccataagttgaaccaactaataatgaatcacctacatttaatgtaccattttgaataagtaaagatgctactgctcctctacccttatcaagcttagcttctataactgttcccttagcttttctattaggatcagcttttaattcttgcatttcagaagttaataaaaccatttctaataagctttctaagttttctcctgtctttgctgaaactggaacacatatagtatctccaccccagtcttctgaaactaaaccatattcagttaattcttgcttaactctatcaatatttgctcctggtctatcaatcttattgattgcaacaatcataggaacctctgccgctttacagtggtttattgcttctttagtttgtggcattataccatcatcagcagcaacaactaatataactatatcagtaacttgtgctcctctagctctcatagctgtgaaagcttcatgtcctggagtatctaagaatgtaatcttttcaccatttaaagaaactgtataagcccctatatgttgagtgattccacctgcttcactacttgtaacttttgcatgtctaatagcatctaaaagtgatgtcttaccatggtcaacgtgtcccatgatagtaactattggaggtctcttttctaagttttcttcaacaacatctgtttcttcttcaaatgcttctaattctgtttcttcttctttcttttcaactaaaacttcatatttttcacaaagtttttctgctgtagagaagtctatttcttggttaaccccagccattacacctaagaatattaaatttcttataacatctgtagttggtttaccaagcttttcacataattctttaactgtaattgtttcacctatttcgattactccgcctgcagcctctgcatttctttcaacttcttcaagttctaattctcttttagtctttttcttttttcttacacctttattaagtgattcagctaactcatcttcatattcatcaacaaggcttttctttccttcttctgaattatctttgtttgcatcacctaataattctgttataagcttagcatcttcatcttcaatcacactcatatgattcttaacttcgacaccaaattcttccatcaataaatttattaattcctttgagcctacattcagctcttttgccaattcatatactctaatctttgacaataaaatcacccccggttaatttcttccttcttcattttggtataaggatattaattttttagccatatttttatctattacagccaaaactttgatttcctctctcccaattgggtttcctagttgttcttttgaaaagccttctataagaggaatttgcttttctgcacagtgattcctgaacttctttttagtactattagaagcatcatcactcaatataacaagatgaaacttaattctattacgttgttcatcacacttgctatatccttcaattaaattcccagatcttttggcaagacctaaaaaattaaaaaacttattcattaactatctcttcccttaatctgttgtatatttcttcatctattgcaacatcaaggtttctgcttaatcgcttagctttaaaagccttttctaagcattctatatccttacaaatataagcacctctacctgccttttttcctgttaaatcaacagaaacttcaccttcttggctcttaaccactctaataagttcctttttaggcttcatctccatgcaacctgtgcacattcttaaaggtattttctttactttcataaaaaaatccccctattcctctattgattctgttgtttctaccgctgcttctgcttgtgacttactcttaatatctattttccaatttgttaattttgcagctaatcttacattctgtccttctttaccaatagcaagtgataattgattatcatcaacaactacttttgcagatttattatcttcatcaacagttacgcttaaaaccttagctgggcttaaagaacttgcaataaactcttctggattcttgctccattttattatatcaatcttttcacctttaagctcgttaactatattttgaactcttgctcccttaggtccaacacatgcacccattggatcaacattttcatcatgagaaataactgctatcttacttcttgaaccagcttctctagagatactctttatttcaacaacaccttcatatatttcaggtacttctaattcaaataatctcttaactagacctggatgtgttctagaaactataatttgagctccttttggagtgtttttaacttcaacaacatataatttaatcttttcgttaaacttatatctttctcttggaatttgttcatttggtccaattgcagtttcaagttttccaatattaacaaaaacatttcctttatcttctcttagaactgttccagtaataatatcatattctttttctttatattcaccatagattatgcttctttcagcttctctaattctttgagtaactacacctttagcaagttgtgccgcaactcttccaaaattctttggagtaacttcaaaatcaacaatatcatctaagtcataagtaggttttatttcttgagcttcttctaaccctatttcagtaatattatcaaaaacttcttctactacaactttttgagaataaacgtgtatttcaccgctttctctatcaattgttaccttaacattttgcgctgatgatgttggtccagcataattcttcttatatgcagcaactaacgcatcctctattgttgtgaataataaatcttcactaatacctttatcttttactatttctttaagagcacctataaactcttggttcatcttaaataccctccttactatatttccccttcaatatttgcagacttaattttatccttaggaatattcattaagttttctgcttcaacaactatactatcatcattaacttcttttaaaatacctttaacattctttttcccatcaatagatttagtgaatctaaccattacttctcttcctataaatctcttatagtgattttcagtaaataaagttctatttaatcctggtgatgatacttctaagaaatatggatctttaattggatccttttcatccataaggtcactaactcttcttgaaagagcttcacaatcacttaaagtgatgccgccatctttttctatatatattcttaaatagaattctccattttccttaacatattcgatatgatatatatcatagttaagttcttctgctatggggttaaccatttcataaatttcattaactaaggcatcaattttcataattatcctcctttgcaatattcaatttttaagtagtttaaaaaatagatatgtaaaaacgcaactaaaaaagtagttgcgttcaaatagaaagagcgggaacctgccccactctactttttttagctattagtaaattacttctttatacatactaacatactttactaataaatacaaggggctaagcaacatttaagttccccattttaaacttaccctaaattcaatctttttattcactaataattgttaatataaataattttaaatcaatctattttttgtattgtttcattaagctatcaaaagcttttaatgacctctttatcttttcatatgatatacaataagatagtctaaaatatcctgggcatccaaatgttttacctggaacagctaagatgttaaacttctttgcttcttcacagaacttaacatcatcctctatcggcgccttaggaaataaataaaatgcaccttctggtttcatgcattcaaaccctatactaattaaatggttatatagtagatctctatttttcctatatatatcagcattaatctctaagtttaaactttccttaattaccttttgaaaaagtgatggtgcattaacaaatcctaatattctgtttgatatattcaatgcagaaactatttcatcaaagtccttaattttagaattaacaacaatatatcctattctttcacctggtaaggataatgacttactatatgaatatccaataaatgaattatcataatattttaatgcacatggaacctttgcattatcatatacaatctctctatatggttcatcagaaattaaatatatatcttgcttaaattcttcttctttttgtctcaatatagctgataattctttaatagtatcttcactatatataacgccacttggattgttaggagaatttataataatagctttagtattttgactaatttcattttttaactccattaaatttggttgaaaattattagtatccgctgatataatcttaactttcccctgaaaattatttacataattaacatactcaccaaaaaaaggcgcaaatacaattacctcatcacctggatttaataaactttttaaaataatatttaatccaccagctgccccacatgtcataataatattttcataacttagctcgatattttctttttcctttatattttgagctatagcttctcttacatcttcataaccagagttattcatatatccatgtactgtattaggattttcttcatttaatattttagttattatatcctttatctcattaggtggttccacatttggattacctatactgtaatcaaaaacattctcttctccataaatactcgaaagcctttttccctcttcaaacattgctctaattgtagagctattagcaaccatagttttcatcttattagaaatcatttttagcccccattaatatattaatttaacttatttttaataacaccaattgctacccctaaaatactaacttccttaccttctaaatatatttcactatatttagagtttgcaggaactaacattggtgcttctccatttaattttaatgttttaagtgttgcttcaccatccaaactagcagcaactatttcattgttataagcagtattttgtctcttaattactaccatatccccatcatttatatttttatcgatcatactatctcctttaacatgaagtatgaaagtgtcctttcctttttctaaccacccttttggtaaaaggaacttttctaatacctgttcattaatttcaataggagtacctgctgctatgtcattatatacatttacttcttctaattcttcttcagaaaagactgtattatcatcaaggtaaatttcttttttagctgatgaattatctaaattaaaatcaacaatatttttatatttcaaatttacatattcaaacttatcaataaatgtatttttcatattatcttcttcaataaacttctttttaaaagcaaagcttttacctttaaaatcagctccaagagtttttaattttctccccttcactaaccaacacatatcatcatttttattttcattatttacaataaatacaaatgaagaatataaataattagcatatatactttttacaaattcaacttgacctttagttaatccttctacactgtctaaaactatatgagtatatttattgctattttcccttgcatatttaattgcaaggctagtctcatcataaacatcataaaatccattatccattaatatctcatcatatacttccattaatgtataaatagcttctctagtaaaagaatttttaataaccctatattttctaccttttctttcaacttcattatactcatctcttgtgaaattacatgctttaatccacataatttcttcataaagttcctctgaagaaattttatttaaaacctttgatttctttgaaaaaaacttcattttcgaattaaatttttcactgtttaataattctaatcctttatctgaagaaattaattctaattttaaattctttaagtttaaatacatatttgaatattcttttattaacgaatttattagattaaattctactcttctagtatctaaagaaaataaagaataaaattcactttctttgctcatttcctcatataaagaattattattaattaattctttataatttgatgataaaaataatattttatcatctttatataaacaataattgttttctaaatttataactctatataaagccgttatagtctttcctgttaatgattttcctttcattaatgaaaagcccatattcttgttttttataaacctattttgtactttagttaatttcattttacacctactgctacttcccattattataaagaaaaccccaaagaaagaaaataaccttggagttacaaaccaaattcttagcttaagatgggatttcacatccatcttaagcttaaaattcgttatctaaggctgtgcctattgctatctccaacttaaatagattgaaattttacaatggctagctcttagataattttattaatttattattaaaaagtcaatgaattttgtagtcatttgttacttaaatactcatctattgctgcagctgcttttttacctgcacccattgctaagattactgttgctgcgcctgtaacagcatctcccccagcatatactccttccttagttgtaagtcctgtttcttcatctgcaataatacatttccatttattcacttctaacccattagttgttgatgaaatcagtgggtttggcgacgtacctaaagacattataactgtatccacatccataacaaactcagaaccttcttttactacaggtcttcttctacctgaagcatcaggttcacctagtaccatttcaacacacttcattcctttaacccatccattttcatcacataaaatctcagttggatttgttaacacatcaaagataactccttcttctttagcatgatgtacttcttctaatcttgctggaagttcctcttcacttcttctatatacaatatgtgtttctgctccaagtcttaatgccgttctagctgcatccatagcaacatttccaccaccaacaactgctacctttttccctacttttactggtgtatgatattcttctttaaaggccttcattaaatttactcttgttaaaaactcattagctgaaaataccccattagcattttcacctggaatacccataaattttggaagccctgctcctgaacctataaacacagcctcaaatccctcgtcctctattaaagaatctactgtaactgttcttcctacaactacattagtttcaatattaactcctaattttttaatattctctatttcatgctttacaacctcatcttttggtagtctaaactcaggaataccataaactaaaactccacccgcttcatgtaaagcttcaaaaattgtaacatcatatccccttttagctaaatcaccagcacatgtaagtcctgatggtcctgaacctattacagcaattttctttcccttagaatcttctttttctgaaagatctatgttattttttctagcccaatctgctgtaaacttttctagcttaccaatagctactggctcaccttttattcctaaaatacatttcccttcacattgtgattcctgaggacaaactctaccacatactgcaggcaatgcgctatatttagctatttctttagctgcaccctctatattttttttcttaagttctgatataaaccccggtatatctatggaaacaggacatccactaacacatttaggatttttacatcctaagcatctacttgcttcattgaaagcactctcttcgtcatatcccaagcatacctctttaaagttttttgctcttacacttgcttcctgttcaacaacaggtgttcttttcattctatcaactacattattcatactaattatgacctccgcatccgcaaccttctctatgatgtgtgtcgccttcttctatttttaataccgctctaccttcttcacttttataaagggtttgtcttctcatactctcatcaaaatctacaagatgaccatcaaactctggcccatcaacacaggcaaattttacttcattgccaacagttactctgcatgcaccacacattcctgttccatctaccatgataggatttaaacttactgtagtttttatccctaattctttagttaaagcactcataaacttcatcataatcataggcccaattacaactgcatggttatattcttttccattattttttactaagtctgttaaacaatctgtaactctaccattaaatccatatgatccatcatcagttgaaatatataaatttttagcaacttgtctcatttcatcttctaaaattataagctctttagttcttgcaccaataataacatctacatcgataccattttcatgaagccacttgacttgaggatataccggagcagcccctactcctccagcaacaaatataatcttagatttttttaattcgcttaattcttcatgaataaactcacttggttgccccaatggtcccacaaaatcttctacaaaatcaccaacttcatactcagctaactctttagtcgcatagcctaccgtttgaaaaacaatagttactgttcctttttctctatcataatcagcaatagttaatggaattctttctcccttatcattatttttaataataataaattgccctggctgagcagatttagctactctagcagcttcaatatccattaaataaatattttcagttaataatcttttacttgttattttatacaccttaataacctcctaaaattttcttaagtatttatataataatttttattaacatactatattaaaagttaagagttagtagtttcaagttagtagttaaggtttaaactccttttcgagtttcataataatatatttttaaattcagattatctgaaatttcaccttaactactcaccactaactactaactcctaattattaaaactctactttatttccatagaatgtacatgaaagtagcttttccattgtttcatcatcaatttctcttggattagatccagtacatgcgtctaaaactgcattatgtgctatatgttttacattatctaagaaatcttcttcagtaactccatattctttcattgatgctggaatattaagctccctattaaatttatttattttttcaatcaatgaatctgtcaattcactattggtttgcccttctaattttaaaactcttgctatatctgcatatctatcttcacatactgatctattgtactgaataacatatggtaagaaaattgcatttgcacatccatgtggaatatgaaatacagctcctattttatgtgccatagaatgtactattcccaacaaagcattactaaatgccatacctgctaaacattgagcttcatgcattaagtttcttgattcttcatctccactaaatgatttaactaaattttcatcaaccatttcaattgcctttaatgctaatggatcagaaaaattagattttaatgatgctgtatatgcctcaattgcatgtgttaatgcatccattccagtatgtgcaacaagtttagccggcatagtttgtgctaaatccggatcaacaattgctatatctggtgttatattgaaatcagctaaaggatatttaatctttgctttataatcagtaattacagaaaatgctgtaacttcagttgctgttcctgatgtagatggtattgcaacaaacttagctttttgtctaagttcaggtaatccaaatggaataacagcttgttcaaatgtaaagtctggatattcgtagaaaatccacattgcttttgctgcatctattggtgatcctccccccatagctactatccaatctggttcgaaatctctcattacagcagcaccattcataacagtttcaactgatggatctggttcaacaccttctattaatttaatttccaatccagcttctttcaaatagctttcaaccttatctaagaagccaaatctcttcattgatcctccgcctacaactactacagcctttttacctttcaatgtctttagaacctctaaagacccctttccatgataaatatctcttggtaatgtaaatcttcccatcttttctcctcctataaatcctcttttttgattttcagttcaaaataaattctatcactttatcctataagaagaatttatttttttaactttatatccttaaatttaatatattaccaataagtaaatataatataattataccataaaaatactatttaaaagtatttttacataaaaaatacctaaagacaactatttattattttcgtctttaggtatttttttatttactattattaaagtttatacaattctcatcaaaagcttttaatatctcatcaactatttcccagttagctaatgatgctcctgctgcaagcatatgaccaccaccgccaaaacttgcagctatatcatttactttaggcccattagatctgaactcacagaatataccaccttcttctttttcaacaaagaagttccaattaattattccagctgtatcttgaagggcatttaccattctaacagctttcattgtttctagtttatattttctaaccacttctttaggaacttttaaatatgccattccattttcagtagtcttataattactataaatatatcctaaaaatttaagttcattttcttcacgtctatacatatttgcatatatatctttagtttctatatcatatgtgatttttgataactttccaaacagatctgtaggattttcaacatataaaaatctacctgtatctcctacaattcctgtatataatgcttttcttccctttttatctatcttaagtttatcagagttatttagatacaaatctaaaatcatttcactacaagaagaataatttgtatcaacccaagttaagttctcaaaaggagcatcaaaaggtttatggtgatctattttaattacatatccacatttattaaacgcttggttatctaccctttccttattcgctacatctacaataattgctaagcaatctttatctaaatcaatttcttcatccattgtatttatatattctaaatttttagagtgctcacctaaaataacaacttttttatctggatatgtattgtttattatactctttaatgcagtttgagaactatatgaatctggatctggaaacacatgtctaaatattgcaattgtttcaaactcttcaattttattgataatttctttcattaatttttctatcataattaattgtctccttgattaataattttattaataatttctagaaaaacaccctacttagctatctaagtagggtaataattttattaattcttttattgacgacttatagaagtttcaacttgagaattcatttcttttaacattgcttctatatcatctgatgtaccagtaacatatgaagcatatttttcttctgctactgttctagctgattgagcattgtttacagctggtgtaaagtatgcaaaagctaaagaatcatttgctacatcataaatcttaccatataaagaagtagtatcagctaaaacttcttgaacaattgaagagtctacagctgactttcttactggtaaatatccagtaccagtagcaaatttagcagtattttcagtatttgttgcgaactttataaattcgtaagctgcatattgagcttctgcagaaacatcattagtaacaaataatgatgcaccttgttggataacagccttatctttaccttcaaaatgtggaacttctactactgcaatttcaaaagcatcattagtatttatgtgtgcgaaacctgctgatgacccttgataagctaataatctttggtttgagaatggacctgataagaatttatcttcacctggaactctaaatgcaccactttgagtattagctctgaagaattgcataaattctttagaccaatcattattaacatttatttttccatctaactcaacgaaatctttaccttcttcttttaatgatgaaataaaggcatttgaacttgaatcaaacccaaatcctgctattcctaattcatcatacgctttttgagaaatttcagctaatttttcaaaagttaaatcatttaggtcctcaacagtataccctaattgttctaataagtttttatttacgtataaaacttcagtagatttagttaaaggtaatccataaattttattctctccccattgtgataattctttaataaaatctggaataaagtctttttcaatatcatctttcattcctattgaagaattatttacatatggagttaaatcaacaactttattatcattaattaatcctgttgcagcatctggataaacattaactattgctggcaatgtatttgattgtgatgcagcaattacttttttgtttaaatcagtaatactaccttggctagatgcagtaactgttattccctttccatttgttgcattgaaatcgtcaactataccttgtaaaatttcagcttgtttaccattcatatagtgccacatttcaattgaaactggttctgttaattctgtaacaatgtcagcattttcacttgatgaattattgcttccgcaaccagttaatgctgtaactgcaactactgcagtcattaaagatgctaataatcttcttttcattcgtttcacctctaaaaccttaaatatatatttttataagaaaagatgattaaaagttaaaatattaattatatattttataactaaactatataataacttatttaaaaaataactatttcaattaatattacaactttcaaaacatcttttttctatataactaattgttttttatcccttagttccccccattgagataccattcataatcttcttgtgtaagaacaagtaaattataactataggcattgtaattatcgttgaagctgccattaataattcatatctatttccaacatctgattggaatgcagttaatccatttgcaagcaatctcatgttatcactattagttactaataatggccataagaaagcattccatgaatttataccaactaaaatacatattgttattattgatggcttagccataggtacaactattttccataagaatttccaatcacttgctccatcaacttttgccgcataataaagttgctttggaatctttaagaagaattctctaagcatatatatgtataatacattagccatatatggcacaaataatgcgctataactatctatcatctttaatgctgaaatagtcttaaagttcgttactataagaacttcacctggaatcatcattgaagctaagaaaattgaaaatattaaatctcttcccttaaattcaagatgtgaaaaagcaaatgctgataaaatagcaattactacagttgtaacaatacttaaagctgttactattattgtatttataaaatatcttccaaaaggagccattgaaaatgctgtgctaaaattactccatataaacttatcaggcaccatagttggcggcgtttgaataacttcaaagcttgattttaatgaagatgctatcatccaataaaatggaaatagcgttattatagcaaagacaactaataagaagtatttaatggctgcttttatattattcctacttttcatctttacacctcttagtaatgaatcttattacgcgctacagttttttgaactaaagttactgttaatataataactaaaagaacaacagaagctgcaaatgctaatgggaaatcctgatctccatagaatctatctattatatatctaaccaccgttgatactgcaccatctaaagtacgtcctccaaatagaacataaacttccgtataaactttaaatgaagcaattaaactaataacatatgtatatgcaatcataggcgaaactaatttaacagttatttttctaaatattgttccgctagttgcttggtcaatcttagcagcttgataatactgtggattaattgaagctatcccagttgttaatattaacgtattaaaagccaaacttttccaaacagcaaatattattaatgctatcatcgcatacttcggatcatttaaccaatttattgaactaattccaattttatttaaaataaagttaattactccatattctgagttaaataaccatgaccacactattcctattgcaacaagagatgttacatatggtaagaaatatatactttggaacattccccttactttttcattttttatgtttgctagtgcatttgcaattaataaagatataattactgataatgctggtacaatagctgcataaattactgtattaaataaagattgcaaaaatcttttatcttggaataggtatttgtaagatccaaacccaaaaacaaatcctttagcttttgtttcatcaaaactaaaaataatagtatttattataggataaaatacaaatacacctaatattataagagcaggcaataagtataaatatccttttctatttttctttaacattttgctatgaactcctcactttcagagtcaaatacataactcttaccatttttaggcttaatagttaactcttcaccttcatcaataaagaattctttatcaactaacattttatatgtttttcctttatggtctaaagttaataatctttctctacctaatatttctactgtaactaccttagtttgaagtcctttttctgcaacttcaaaatcttcagctcttactccaagtattaccttattcttattttttggtaagttctcaattgttaaagtatctaaagttcctactccatcttttaaatcaatgtcaataaagttcatttctggacttcctataaatgaagcaacaaacttattaactggattcatataaatatccgttggtgatgaaacttgttgtattgctccatccttcattaatactatttcatctgagatgcacatagcttcttcttggtcatgtgttacaaatatagccgtaacccctgtttctttttgaattcttcttatttcttgtcttgtttcaactcttaactttgtatctaagtttgataaaggttcatctaaaagaagaatatctggtttctttgctaaagctcttgcaattgcaactctttgctgttgtcctcctgaaagctgagctggtttcttttctaattgatcagctatttttactatcttagcaacttcaactactcttttttcagcttcttccttattccactttaaattttttaaagggaataatatattttctcttactgtcatatgtggatatagtgcatagttttgaaaaacaagccctattccaagttgttccggttctaaacctgttacatctttatctccaaaaaatatttttccactaaaaggcttgtgtattcctgaaattgtaaacaacgtagtagattttcctgaaccagatggccctaataatgaaactagcttgccttttggtatttgtaatgtaacgtcgttaattgccttaaagtccccaaattttacaactaggttttctagtcttattcccattgataattcacctcatatttttctaatacaataataaaaatgcataaacattttttcgcaccgttacagaatacgacatttcattgatgtttgtcaacatttttcctttatgtattatcctcatttttttatgtattttattctaattaatttccttgtaataactttgggaaacattggattatattttttctttttcttccaaattacgcccttgttacttacatattttatcttttcctaaatactttaaatttatgtttaccattttttcacttaataaagttttgctttttttatttttactgccatattcaaattttaatttgaactttacctactataatcactttcaatctttgctcaaaaaatttgatacatatttaactttttagacacacaacaaaattatccaatattattaaatttgtaataacattattttgataatctatgaagtatatctccaactcttttttcaacgcttttataacaatacttataagaatttttaaaccaattaagattttctaaaacagcatcgcaagcaataaatgtaataatggctatatgatcccatctattcataaaaatattcctcatgatatttattttatactatattatatgttctttatttttttgttgccattgaaacttccaaaacactcccaatcttttctatacttaaaaaactaaataatccttgcatattttaacattcttaaatattatatttatgtaaagatatatataaggaggtacccatgttaccattactaattattttttcttatttaatgggatcaattccaacaggctatattttagtaaaaaagactctaaacaaagatgtaagagattacggaagtggaaatataggcgcaactaatgtaaaaagagttgccggggacaagctttcaaaaatcactgcaatttgtgatatgttaaaagctgttattcctgttttattaacaagaattttaatttggactgatattctacatactaatgaaagcttaagtttatcattagttgctatagctgctatattgggtcataattacacaatatttttgaaatttaaaggtggtaaaggtgttgctacttctgctgctgcattcatggttgcattgccaatcccatttctaattacagcagttgtgttttttggtttaaaactatttactaaaatagtttctatacgctcattatctgctggcgtaactttatttatttcaactttattgctcgggtatgacaaatactatgtatgtgcaaccttgtttgcttgcatacttgttttttggagacataaaagcaatattgtaagattagctaaaggtcaagaaaagtaaatctatataaaaaaacactgagatttgttattcagtgtttttattttttaggaggttatatgactttaaaatttatttatcttttattagtaaacctattactattcattttaatgggtatcgataaaagaaaagcaattacaaataaatggcgaataaaagaaaaaacactcttaatattatgccttttaggcggaagtatgggtggaataataggaatgtacaccttcagacataaaactaagcatttaaaatttaaaattggttttccagttatttttgtaattcaattaatagtagtattatatactataaaataaaagacgttgcattttttattgcaacgtcccataatcaatcattagttacataagtaactaagtgattataaatttatattatcctattattaattttttattcattatttattcttatattttaaattgtacaacctttaaatttatattataattatagaaaaacttatataattaggggtgattatatgaactttttaaatggtacttatggatttgatttattatctatagtacttgttttattatcttttatacttaatatatttgatatcacaagagctttaggcattattgtctttgcatatgcaatatatagagctttttcaaaaaaaatatataaaaggaaagaagaatacaatgtattttatacatacacaaataaactattaaataaatttggtaaatctattccttataacttacaaaactatgatttaaataatatttcatttttatttgatagaattaaacaaaagtatacccaatttcgtgactataaaattactaaatgtcctaaatgtggtcaaaagctaagacttccaagaaagaaaggtaaaattgttgttacctgcaaaaaatgttctacaaaatttgattttaggacataaaacaaataacctttagcaaaatttattttgctaaaggttattttgtttcataaataattaatattaatatgtgggatactaatattacataattttatttttctatggaggttattatgaaaaaaatattattaattatcccattattatttataaatttatcttttaattgcattagtacatactctactaaagtatcaaataaaaatattcaaagtactgtttatactcctaaaagtgttccttctaaatggtggtataattaatttaaaagggtttttaccctttttatgttattataggcttttgcccttttgcaattaaattcaaaaaaattattgtacaattctctctttcttttttgtcacagcacattttcattatcttgcctaacctaggattattcatactaacaattttgattaattctggaggaacattatcaattccaataatattctttattccaactaaatcactatgaattgttacagcttcaaaatctaacttatcaaacccttcatattttaaaattttcaaaagttttctcccaatttctctgttccatttagctcttctctctatttgacttataaaccctcttccacttttaaataacatatcaggttcacttaccccataaagtcctctatctgaatcaataattgccactattccacctggtttcaacaatttatatatttctcttgttgcagctaaaggcttttctaaatgttgatatacaaatctgcaaataataaaatcaaaagaattttcttttaatccactattcaaaattgatccatacttaaaatttaatctttcaataggatattcttttaatctatcctttgctatagacaataagtttttatctatttctaaagctgttattttactattaggcaaattttctaacaataactcagtgtatgctcctgacccagagccaacatctaatattttcattccatcctttaaacctaaccatttcaaggttctaaactctttattccatcctagcttagcttgggtttctaatctatttacctcattgttcaatccaataatatcataaattgaattataactcactttaatctccttttaagattacttacatatatcttatgatgaacatattatattggttcattaataattgttttctacaatataaaattaagtagtattggaaatgtaataagtgaaaataatgttgttataaatacaattactgcagaatattcactttccttatcaaaacattctgccaatatagatgtcattgcagcagctggcattgcagtgactattattaaagttttgctcactacagaattatcattaattattctaaaaattatgattaatatacatggcataactactaatttcaaaaatgcactataatatatagtcttatccttcaaataagaaattatttttgcatttccaagtataacaccaactattatcatagataatggtgaagtcatatctcctactaaatctaacgtagaagataaaacactaggaatattgataccaaaaatcataattattaatccaataactactgcaattatggccggatttaataacacttgttttatatcatcttttttcattttcccattaaataaaacaactccatatgtccataaaaaagcagtaaaaaacaaattaaatatagaagcatatattactccttcatttccatatatactaaaaactataggaaatcctataaatccacaattagaaaatacatttgcaaactgtaatattatttttttcccttccttaatcggtacaagaaatatatatgatacaactattgaaataagtaaaactaatggactatatataaagcatttaataatgctactttttaattcatcacttaaatcaaatataaacgatgatactacaagacatggtaatgtaattttaagaagaatattggttaatcccttatttatttccttagttattattttcatcttagccgaatataccccaactaaaattattaaaaataatgatatcactccattaactataactgataaattcattcattcccctccattcttttccaacctaattattatacaatgaaaaagataaaaaagactaattattttatgatttctcataaataattagccttaattatttatactattaaaataatgataattggttagtttcagacatgccttctaagcaaccatgattacttaatgtttcaattacagtttttgaaacctttgatcttaatcttaaatcttccttagaaataaactctccatcttttcttgcttctgcaatagattttgcagcattgactccaactccttgtaatgaacttaaaggaggtcttagtgcattatctataattaagaattttgttgcatcagatttatataaatctacttttaacattttaaatcctcttttgtacatttcaaaagaaagttctaatacggtcatcaaccctttatcttttacagttgcttgatttcccagctcatataattcttgaagtcttgcatgaactgcagtctcacccttacatattaaatctgcatcaaagtcatcagcacctctaaccgtaaaatatgttgcataatatgctaatggataatataccttataatacgcaactctcaccgccatcataacataagcaacagcatggcctttagggaacatgtattttattcttttacatgattctatataccaatcttcaacattattttctttcatggtcttctcaaactcttctgttaatcccttaccttttcttacactttccattattgtaaaggctgttttaggagcaacacccttatacataagataaaccatgatatcatctctagttgcaatacaatctcttaaggtagtatatccttccttaataaagtattgggcattattaagccaaacgtcagtaccatgtgaaagtcctgatattcttactaagtctgaaaatgtttgtggttgagtatcaacaagcatttgacgaacaaatttagttccaaactcaggtaaaccatatgaaccaacttcacattctagctcttcttttgtaacaccaagagcttcaggtgatgtaaataaagacagtacttttttatcatttaaaggtatagtcttaggatctaatccagttatatcttgtaacattctaagtactgtcggatcgtcgtgcccaagtatatctaacttaagcaatctacctgaaatagaatgataatcaaagtgtgttgttgtaacgtcagatgttggatcatctgctggcctttgaataggtgtaaaattatatacatctgtataattaggtacaaccattatcccccctggatgctgaccagtagttcttttaatccctgtacaaccaattgtcaatctttcaatttctgcttgcgatactacaagtcctttttgatctaaatactttttaacaaatccatatgcagttttttctgctactgtaccaattgttcccgctttaaatacatatccctttccgaataatacctctgtatacttatgaatatctccttggttatctccagagaaatttaaatctatatctggttctttatccccttcaaatcctaagaatgtttcgaaaggaatatcatgaccatctttaatatatggcactccacaatctggacagtccttatcttcaagatcggcacctgaactaacagatccatctaagaaaaaatgagactttttacattttgggcaaacataatgaggcggtaatccattaacctctgttatatcagacattgttgcaacaaaagatgaaccaacagatcctcttgatccaactaaataaccgtctgaataagatttagcaactaacttttgagcaattagataaagaaccgcataaccattattaataatggagtttaactctttatctagtctcttttgtaccacctctggtaaaggatcaccataaatagagtgcaccttgttcatagtcatatttcttatatcatcatccgcaccttcaattttaggaggatatgtttcatctggaattggttttaaattttcctcaactgagtcagcaattgctgtaggattttttattactacttctttagcaatatcacttcctaaataagcaaactcctttaacatctcctctgtagttctaagataaagaggcgcttgattatcagcatctccaaatccctgtcctgccattataattcttctaaacgcctcatcttgaggatctaaaaaatgaacatcacaagttgctacagtaggtttattaatttcctttgctaaatcatatatttttctattaatatcttttagctcatcttcatcttttactgaacctttttctatcatataagcattattagcaataggctgaatctcaacataatcataaaaactcatcacttcttttatttcttcatcactttttccaccaactactgctctataaacttcaccagcttcacaagccccaccaataataagtccatctctcatttccattagcctagactttttagttctaggtcttctaaagaaattatctatatgagcttcagatactagtttatatagatttctaattccggcttgagttttagctaatataattatgtgataagtaggtaattttttaatatcaactttttctaaaaatactttattcaattctgaaagagtattaatttctaactcttccttaatttttttaatacactcaagtaatatatctccagttgccttagcatcatctacagccctatggtggctttcaagctttatccctaaatgctttgctacaatatttaattttacagattttaattctggatataaaaatctacataacggtactgtatcaactacagttggttcaaatttcaaacctaaatcattacaatttttagaaataaaactacaatcaaagctagcattatgcgcaacaactacagaatcacctataaactctaaaaatttaggaagtatgtcttcaattgattgtgcatacctaaccatatcatcattaattccagttaattctattattttatatggtataggtcgtcttggattaacaaattcactaaagttatcaattatttctccattcttaattttaactgcacctatttcaataattttatcatttttagatgaaaatcctgttgtttctaagtcaaataccacataagtatcatctaaattttgacccttttcatttaatgctaatggaactccatcatcaactaaatatccttcaaccccataaataactttaattttatttttcttagcagctatctgtgcatcagggaacgcctgaacaacaccatggtcagtaattgctattgccggatgcccccacttagcagctctttctattattttagaaactggagtaactccatccattgcactcatagtagtatggcaatgaagctcaacccttttttcttctgctccatccatcttctccatctttttcatttttaaaatatctctacccattattacaacttctctttggtaagtatcataaacagcttctcctcttactttgcaataaagcccctttttaatattatcaagaacttcatctttttcttgaggctttaagaaacatttaactgttattgaacttgtataatcagtaatatagaaagttaaaattatcttacctgttttagtttccatagtatcaactttaaatacatctcctaaaactgcaacataacctgatctttcatcaatttcattaattggcgttgcttcaatagaaatatttctgccataaatagcattttctgcttttgactctctcttatatccattttctttcttttcataagatttcttttcagctggctttttctctgatggcttacttcctccactatggctgttactaatttcttgtactcttgcttgcatcgctttacttaataattctcgttcttctttttccctagcagcaaaatctatagtaacttccatttccggatcaaactttagttcgaacctacatgttataccaaacattgcttttacagtatcttctaatgacttttctccatttttaccttttaaatgatctgttaatttatcatatccattgtaaatgataactttgtttccattaatttcttttctgcaatttaataaaagacttttacacaaaggagtatttttaatagtgcttgaaatacattcaatccagtgattttgtattacttcttctaaacttatgtctgatgcatctctataaaatactatttcaacagtaattcttatcattaaagttttacaaattatctttttaattaactcttcttcttcatgaactaatttttccttacctcttaaaacaacttttaagatcatactttttcttaaaagttggaacttaattattttaagttctttatcttctaaactctcatgtttatttatttcaagggttagcttctttataatatcgtcactcaatcttttacccccaatatttaaattttttcaactacatcattatagcataattttattattcttaaagatacagaacaatatgaaatttcagttaaagttatacaattactcttattctactgtaaaatatctttccttatccctttacaaaaacataaaaatatcgatacctaactagtatcgacatttaataatatattttttatattaatttttctactacttcatttggtgcaggaactgtaaaaattaaatcttcatcaactcttattttacactcctctttactttctttaatcttatctatagataatcctccaatactaacttctttaaatttagtaggagcaacttcaactttaaataaagtatctttaattcctgtaatttttaaatcaatttccccaccgtcatttttaacttttaaacctataatattatttccctttaaagcttttttatcatttggaatataagctacatttacttcacctgtaattgtaataaatcctccacttaactttcttttcactaataatttcatattatattcagaagaaagttcatttaataatttacctaatttatatactgttaattcatgtaccataattttgttccttttcttataatttaatttattcttattatatactataatatttattcataaaatagtaaaaatgggctataataaaattgtaaaatagtgtatagaaaggtagtaattaaaaatatgaatattagatttgctgaacaaaaagattttaatagctgcgtagaattagacttacataaaaatgctagtattataaagaataaaattgatatgaaagaagtaatagtagctgagctaaacaatgaagttattggttgcttaaaaattgaatatatttggactcaccttccatttataagttacatagttataaaaagggattatagaactaatggtattggaaaatcactattatcattcttagaagattatttaagaaataatggacaatctaccttattaagttcaacaatgacagatgcggttaatccacaaaagtggcacttaaaaatgggattcacagagtgcggaatgctatgtggaattaatgatgatggtgtaggtgaaattttctttaaaaagaaaatataaaatattagattcgacaaaattccaataagttgaacttattggaatttattttattaatttacttatataaaggcatattactaaagacaaattatatataagttttaattttttacattttatataaacttactaaatttaatcctaaactatgttattttaaatcccctactattttactcccatgcatttctttacatcctatataatttgaaagttctttataatttttataattaactccaccaccaactaaaatagtaatcatatcattacttttttctataagtctcttcaatacattttttccatctgtagcatgtgtattgcaacctttagttaaaactctatcaactttcatatcaataagctgatttaatgcttcaaacttatcatctatttcatcaaaagccatatgaaaagtaacttttaatccactggataactcaattaattcattagttctttctatatcaatcttattatccttatttaatataccaaatactacagtctcaacccctaattctttacagacaactatatctcttttcattatttcaaattcatcatttgaataaacaaaatctccacctcttggtcttattattaccgctatcggtatattaagatttttctttgctaaatatattgttccataagaaggagttgtcccaccttctgctaagttatcacatagttctactctatctgcaccttgaatttctgcttttttagcctcttcataacatccaacacaagcttctaataaaatactcataagcttcctcccttgtactatttcaatttataattttatatatttaactttttaagcccccacattcatttagatcttttcttaattcacttatacttattgaatccttttaatacctttttcatttgcacctttaatattttcaataccatcatttctaaacatactttcttctagaattaaatcacaattatttaaaatcttactatatatttctttttctggatttaaaagcttttttctaaatataattatatcatctaaataaataacaatacaaaaaaaaatcatgtcaaacttcatgacatgattttttatagttatttattcacttttaaaggtaaataaatattctggctcaaatttaacctttatcttttcattaatgttaaataccatttcttccttagaaatagtaaaatgtattaaatttgatttacttgcattaattctcctaatatataaagtataatcaaaaggattttctactatattttcaatactcatctcaaatacattttcatcattttcttgctctttaaataatttaatattatgagatcttattgctatataatcaatatatttttcatcacttgaacactttaactttaagttccaatcttctgctaaaataaaattatcttctaatatcttagcctttgatacatttttacatccagtaagcttagcttcagccaatgattttggtgtttcaaacaattcatttttcttccttatactcttagcttttccaccatcaaatactattattttatcacataccctataagcctctgctatatcatgagttacaaaaactactgtcccattataatcttttagaatctctacaagttctctctccattgtagcccttaaatgattatcaagggcagaaaagggctcatctaaaagcaaaacatctggtgatgtaataagagcccttgcaagtgcaactctttgttgttgtccacccgataactgccaaggatatcttttttcaaggccttctaatccaaattttttaataaaattagatgataatttattcttttcttctttacttatcttatctaatccaatttcaatattatcttttatagtcatatgaggaaataaagcataattttgaaataaaaatcctactcttctatctttagttttaatatttattttctgttgtgaatcaaaaagaactttatcattaattattatttttcctgtatcagctttttcaagacctgctatacacttaagtgtcatacttttacctgaacctgacgctcctaaaaagcctataatgccacctttactttccatagaaacatctaagttaaaggaagataaatttttagtaatatttatatgtaaactcataattacctccccctattacctattaacttttgctgagtatcgcaccaataatttagtaaaaatatcattataaatgaaattgaaactataattaaaacccaaatcatagccttattcatatctccaccttcaacagcaaagaatattgctactggcattgtttgcgttcttcctggtatatttcctgctatcattaatgttgccccaaattcgcctagggctcttgcaaagcttaatactaatcccccaattattcctggccaagcaagtggaattgcaattttaaaaaatatcttagtttcacttaatcctaatgttcttgctgctgaaatcatatttttatctatttgctcaaatgcagaacgacaagttctatacatcattggaaatgcaactacagtagcagcaataactgttgcactccagctaaatataatatttttattaaaactcataaaaatctttcctacaaatccatttttcccacaaataagtaataaaaaaaatcctataacagttggtggtaatattagaggaagagtgaagattccatctatgaaccctctacctcttcctttataattagccattttataagatataaatatacctattattgaagttataatagttgcaagaaaggctgtttttatcgatatccataaaggtgaaaaatccataacttataaccttactttcttcaatttaactctacagaatattattctacagatttatatccatacttttcaaatatcttttgtgctgcatcagtaaataagaaatcttcaaatttctttgcttcatcaacattagttgaatcttttataactgatactggataagtaattgaagagtgattatttacttcatcaatattttcaactatagtaacactatcactacttaatgcatcacttaagtatacaaatcctaaatctgcatttccagatgcaacccaagctaaaacttctttaacatccttagcaaaaactaatttatcagtaatactatcttttattcctgtgtttgttaatacttcatcggcatatttaccagctggaacactttctggttcaccaacagctatatgagtaactttatcactttttaaatcatcaaagctagtaatatcaattccattagctgctataagaactaaagaattttcaactaaatcttttgttgtatcgtcaactaataatccctcatcttttaatgcattcatttgcttttgccctgcagaaataaataaatcacaaggtgctccctgctctatttgttgttgaagagaacctgatgcaccataatttacaactaaagtaacattttcattactcttcttatattctgtttctaaatcagccattacttcttttaaacttgcagctgcagagatatttagctctacagcagcctttgcctctgtatcacctttactagtattttccccctcattacttttaccacaacctacaaataataagctacagcatagtaacattgaaatcattcctaatttcttcattattacatcctccattttctttaaacaagttcattttgttatgtttcgttttgttttgtcatgtttaatacaaataaaataatatcatatctcgttacttcttgcaatttatttattaataatgataaaattatcataatatataggagggataacatggacttaaaatcttctttgactccattagaagtgtcagaattactaaagataactaaaaacactgtttacgaacttattaaacgtggtgaattaccaagctataaaatagggaaaaaaattagaattgatatgcaggatgtagaagaatatataagcaatcaaaaaattggctttaaacaatcaaaatatatcgaaactcaaaataattcagtaactaatatacctcaacaaccaattaataattctattacattaggtaatcaatctattaacgaaattataattgctggtcaagatattttattggacatcttagctcgatacattgaagaactatatccagactttactgttttacgttcttataaaggtagttataatggattatatgatttatataacaatagggtttctattgcttcgtgccacctttgggatggagacactgataactataatgttgattatgttaaaaggcttgtccctggaacatcttgtgtacttattaatttagcatatagattacaaggcttttacgttgctaaaggaaatccattaaatataaagtcttttgaagatttaattaatgacaatattaaatttgttaacagagaaaaaggtagtggcgttagagttttacttgacgagaagttaagattacttaacattgatccacattgtataaatggatactataatgaagaaacttcacatttagcagttgcaagtgcagttggccgtggagatgccaatgttggaattggtaataaaaaagcttctatgcaagttgaaactattgatttcataccaattcaaactgaaaggtatgatttaattattaaaaaaagtgatttaaataatccaatttatcaaaatataatttctattttatcttctgataggtttaaaaacgaactaaaaggaattggtggttatgacctaaaagatcttggtaaaataatggcaactacttagccagcatatagtaaaataatctaaaattactgtttcatcttagttaatttatagtcagcaaaataaaattataattaatttaactaactaataaaacaaataaaaatagttttattacttattactattgaaattcaaaatttaaaatcatattatacggaggatttatgagtaatatatttttaaaagaaccttggttaaaatgggctattgaaatacaaagtatagcacaatgcggtttgacatatacaaaagacatgtatgataaagaacgttatgaaaatttgagaaatattgctgctgaaatgttaagttacaaaactgatattccaactgataaaataaagaatttattttgtaatgaagaaggatatcaaacgcctaaattagatactagagctgcaatttttaaagatgaaaaaatattattggttcatgaactaaatggaaaatggtcattacctggtggatgggttgatgtattagaatcaatagaatcaaacacaataaaagaagtaaaagaagaatctggacttgacgttgttgccgataaagttatagctattcaagatagaaataagcataatacaccgctttacccctatggtatatgtaaagttttcgttcaatgtgatgttgttggtggtgaatttattgaaaatatagaaacctcagaaatcggttacttttcacttgataatttacctccactttctgaagaaaaatctaattttgaacaaatagaaatgtgctttaaggctaaagaaactgaaaactggaaagttctttttgattaaattcaaatactctatttattatttatattcatataaaaaaagatataggatttattagttattacataattctcctatatctaccttactctatttaaactaatacaacctttaatttatgcttagataaacgtaactcgtcattgcctttcttattaaatataattaaattttactacaataattctactataaattattaattgatattatatattttttactgcttgaaaatccccttcaagcataatctattactacataaattacaaagcacttatttattacttaggaagtttaattttaaggattacattttactaatttatctctaaataagtgctttgcaagctatataaaactttaggaggttatcttttgaaataatatcaaaaagataatgaaaatttaaatgtaaaaatagacaacagtaccttaagataatcttaaggccccattgcctttattaaacaaattaaatttactatttgtataagatatatgatatcctttttctatatattgtcaattttttattatttgttttcatataattcttttaacttatctgtaaagcctaatctattttcttctaaactccctaatctaaagaaacaattacctttaacattagatattcctcttgaatatctaatttgatttattacctcattttcatttaaccatgcctctccataagttgaatcatttattttataaatagcatttcctatatatagttctacatttgtcccatcaacttgtttagcccaccaatcaacaagagtagcataaggtgcatttgtattatcaaattgccaatatatttgtggaataatataatcaatatatccctcttttatccacttctttgaatctacataaacatcatcataactacttaatccacttgttgcacttcctccaactgattctccatttctccagattccaaatggactcactccaaaccttaatgtagaatcttttgattttattgcattatttagttcactaataaaggaattaacgttatttcttctccattcttcctttgatgaaaatccttcaccatactttttatatgttgaatcatcaggaaaatctaatcccttgactggataaggataaaaataatcatcaagtacaataccatctatattatatttatcgactacttctaaaattaaatctattacatatttccttacctctggtattccaatatctaaataactatatttatcatattttacaatccaatccttattttcttttaaaggacttccttcaggtaattcattaatataatcatcaaaattaaatttctctgaattactatctattctaaatggattaaaccaagcttgcaattctattcctcttttatgggcttcttctattgcaaattctaatggatcatatcctggatccttgcctaattctccagttaaatattttgaccagggtgaatactctgactcatataaagcatctcccataggtcttacttgaaaaaatacagtattcatattattatcttcaataaaatccaatttttcctttaataattccttttgcatcttattgttgttatagctacctacttcaggccaatctaaattattaactgttgatatccatacccctctcatttctccttgctcctcaaacttgctattaaaaatatcattactattattactttcaaccacttctttttcattattgctcttactactatttattttgtctagtttaatatttaaaactattgctacaactatccatatagcaataaaaattataaaaaacttataactatttttcatctcaatctcctgttacccaaagtcaatattttctttatcttttacataattttattccctatatgagatatactcttttctattaaaaattattccatattatttattaccttcctatactatttaatatatcaaactatacatgatcttaaaaatttttgtgcccctttttgcaaaaaaacaaaaaaatagcctatgaaaataggctatttataatattatagagcttttaaagctactgcatttaaaatgctccatggtttattaaaatgtggttggaagaagaaatctgtcatagctaattcttcaatagtcatttcattttgaataacaactgataaagtattcataaattgagttaaatctatatcagaaattatttgtccaccgattactcttcttgtatctttatcaaatactaacttaacagtagctggtaagtatgttggcataaattcaggtctatagttatcagttaattcaactgaaccaacattcattttagtagtagctttagcaacttcttctgttaagcctgttgaagctatacatttttcgtaaattttgattcctgaagtaccttgtgttcccatatacttcaatgtaggttcaactatatttcttgcaactaaagttcccattcttacagcatttgttgcaagtggaatgtatcttgtatcatgagcaggattgtatttaacaacacagcaatctccagctgcaaaaacatcttccttactagttctcatatattcatcaattataatagctccatttggtaatgtatctaactttccttgtactaatttagtattaggtgcaaatccaatacataatactactaaatcgccttcgtaacttcccttttcagtaacaaccttagatactttcccattttcaccttcaaacttagataccttttctcctaatactaagttaactcctctatctgtaaattctttttctgcgatatcagtaaactctttatctaagtatttagccattattctttcttcagcatcaattagagttacttttttaccttgcatctcaaatgcttctactaattcaactccaatgtatccagcaccaattattactacattcttagctgtttttgatttttctataatttctactgcatggtcatgatttttacataataaaatattatctaaatctccaccttcaaatcttggtactattggccatgatcctaatgttaaaaccaatttatcgtaattatcttcaaattcttcattagttaaaagatttttaacttttaatattttattatcaaaatcaatatttaaaacttcatgcttcatgtttgttacaacacccattttagctaagttttcaggtgagttatagaaaagatttttagtttcttttataactcctcctacatttaatgcaattccacaagacaagaatgataaattatcatttttttcatatattgtgatttcactttcagggtgaagttcctttaaattaactactgctgcagttcctgcatgagtacatcctactactactattttcatattaattcctcctaaagctaaaaactatcttaaaatatttatttttaattaataattattttccttaattaaatcatactactttactaaggaatagtaaagaggttttttaaaaaaattgttttttttttaacaaacacctttggataatacatttagtctctttatctgttattttttcttattcaatactctttatgtatttctatattaactaatttatgaacatataaaattctgcggctctactacattaatttacaaataatttattttgtattaaaattatttctttataattttataaagtaaaactatatactctattctctcttatatattcatatttttatatctaaacctttttattttaattttattgcattttatatcgttttcactaattttgaacattttttgcctaattttagtaaacatatcaatagttcatcataaaataccagtaagtaattatataaggagaattctatatgggaaaaagtgcatggaaatatgctttagaaattatttcgatagctactgatattgatgaactaaatacaaaattaagtaaaacagataagattagtgaacgtacaatactttcagcaaaaattgatactcttgaagctaaattgtttgaaattaaagataagctaaaatcagttaatttaacttagcttatttatacttattaaaaaagagaattcaaactgactttaatgccaagaaagccctaggttttatcctagagctttctttattattatattaattcttcttttttcttatataccattactattccaccagcagtacacaataatgcaattattatataattcattatgtttgtcccaccagtttgaggtaatatattaccatcaacagcagttgatttttcagcaattataaactttcctattttatctgttgtaaatactatagtattaccttcaattttactttctactatttcaaatttcttactttcttcattatagtagaatgcagataatttagatttatttaatccttttaattcatcatctgttaatgtaattgacattgtaattctgccatcatttgtagtctttatctttgtaaacttatcgccattctttatagataaatctacttcataaacttttttcactgcctttaacccttttgtaatagcattatcaatagcatttttaaatttcactattatagatgaaccatctacaagtaaagttttatcaaatacactaaatggtattaataatgtttgattgtcatttactatttctatagaaccattaccatttttaatactttctatatcagtaatctctatagtaacttcatcacttggtttactaatattaattttattattaccatctttatctgtgattttatcaatctttatagttccatcttcttccggcttaacttcaactgatggatcatcatcttctgagtcagggtttttcttttctactgtaactttaatttccttagtagtttcttttccattttcatccactaccttatatataaccttatattctccttctttagaagtatcaactgtattttcaactacctctaacttttctgtaatatcatttccttctgcatcaactgcagtaaccccttctaatgcattaaatacatctccaacctttaacattttatcatttgcattgatagttggtcctggtatttcttcaccttcacccaatcttgttatttctagtgataaatcttttgtagcaaatcctattgcttcttcattattattaaatatatctgggttacttttattctcttctgttggttcgatatgaattttaatatcattttttccaacatttaatttaacttgatgtgcgaaagttccattttcatcaacttcaactttttcgccgtttatagttaaatttggatctaacattgaattacctttaactgtaatagtttcattttttgtatagcttccatttgatggatctaatacaactacaggcatatccttccatcttacaacttcgttttcaacaagcattttaccattaccttgatttacaactgtaattttttcattaccaccttctccagtagtgcaaccatatttactttgattagcagcctttggatttgaataattcattaacgcttcttgattccacgatccacctttaacatacttatattcaatttgttcaccttctaaaactgaaatagtataagtccagtcagctgaaactgcaccattcctactcatttcccatgaacttacatcccatccgttcattcctcctggcattgttattactgcatcaagcggtgtatacgaaggagcatgtaatttaaatgttacttctaccataactaaatccggtgtaacattaactaaatttgacttaattgaattaccaccattagtataagcaattacttcatatttatattcagttttatttttcacatctgtatctttatatgatactgctaatttatcttgaattcttgcaactacaactccatttctaacaatttcatatagagctatattattttctccaacaacatcccaacttaaatttacttctcctgattgttcttctggagtctttaacttaatagcatctgctggagttacatcatcattaacagataatttaaatgatttaacatctgtagactttatactatccttgtcatcaaatccataagttcctttagtagtaaactcaaacttatattcatactttccatctttatttgctataaatgacgctgtgaatacatcattatcctcattttcctctaaatagcttgctttaaatattgtaaattcctcatctccaggatatttaactaataaccttccaactaatccatcagatgctccttctacatttgaaatatcttctatatatacttcagaattaacatttatagctgatgatatatcaactttatcagcttttacatcactcaagttaccaagccatgtaatctctgaatgtggagttaatccatcactccaagataaaggtgattcatttccatctttatctattgcacttactgcaaagtataatctattaccatttgttaattgattaattataatctcagtattatctactatcttaacttctgtttctaaacttcccttaaagcttgaagaataaactttatattcttttgctccttttacagaatcccattttaaagttacttctccattaccttctgttcctataactttactaactgcttcaggcaattttataacattagtgcttgtcatcattctaccagtcattgcaggaacagttatttcaacctttccatccttaactgaaactttataattagaatctagtccatcaacaaaatctgtaccatttccagtaaatttttttaaatctaaagttacttttgcatcgctatttgtagggttaatagctactatagcatggctatcctcatagcttcttccatatacatatacaccatcagtgccagtatataaagttgttaaatcaccataagaaaataattctttattattttctctaactgatccaattgcttcatagaaactaactaatgaatcatcttcatttccccatggataagttcttctacagtctggatccttagatcctgtaactccagcttcatctccatagtaaatagtaggagctccagcataaccaaactcaaataaagaagcaagctttaatctttgctttcctaaactttcatcatagtccccgaattcagctctttcagaagaatcacttccccctcctaatacataaatcgctcttgcaacatcatgagaccccattaagttcattaatgcataaaacgcttcctctggataatcttcataaactgccattaatgtatcatttaaccttgttgcattaccattttttaaataatcaattaatgcagctcttattctataattcataaccgaatcatattgatctccaataaaatattttgaggcatcatcccagatttcccctaaaataagtgtttcactattatgctccttcattacttctctaaaatcattccaaaatactgtatcgacttcattagcaacatcaagtctccaaccatctgctccccagtcaatccattgttttgcaacagaatcttcatccttatagatataatcaactaactctttgttattccattcactttctttattgacaaattcatcactttcactagctaaacctaatttaatagcatctttcttacttaatgatttaaattctggtagtgaatcatatccccaccatccttgataatcatatctttcatttgttgttccaacatcaaccttagtattattaatattgaaccataaatgccatttttcttcactaaatgtttgtccatcttttataaaataatcatctgccttagtcattgcggcttcttctgttattccttcattattcattgaatcatatacatatgaccaatattcatatgcaccaactgtatcatatttaccatatctatcaaaataaattgaatcatcaccaacatggttaaatactccatctacaattaaatgcattcctctactctttaactcagcagtaaatgccttaaattcttcttctgttccaaacatagggtctaaagttttatagtctgtagcatcatatttatggttcgaagcagccatagaaactggatttaaatacaaagtattaactcctaatccttgtaaataatctaacttcttttgaattccttcaatatcaccaccaaagaaatcatttgaccatatttcgtcaccagtgtatgctccatcaatatcgtccatattattttcacccaatctagggttatctggtaatgagttccaagattcatgagtttctattggttcctctcctcttgcattttctttagctgtatcatttgattcatccccattaaagaatctatcagggaaaatttgataaacaactgcttctttcatccaatcaggtgttgtatagtctttgtcataaacagttaattggaagaatagtccgtttttatctcctacagttcctattttaccttcgctaccatcttcacaataatattttacagtatcaccatcaccagcaataaatttatatccatatactccaatttcatccggagtaaatgtagcttcccatatatcaacttcttcctcatctacagtgatagttgaaaccttttccatattataaagatctgatctatttgtatttgtatttctcactaatactctagcatattgcaaatcacctttttgagaatgcattctaactgttacatcagttccttgaacaacagccccaaatggatatttataaagactatcccaagtattgtgatacaacatatcaccatttacttggccatctaaatctgttatttcttttgaaaccaatggcgaatgatacccaaaagcttcttttccttgtgataagtatacatctaatgttccatcattagatacatgcctcaaatcaataaatctattactatctacatctttttcggcccattcattctcaccttcagttctcttaacaatgaaccccatattagtatcattaactaagtttgcatataccttagttgctactttaccataactatcttctgaagttaattctaatgtttctccatcatttccgtctaaccatgtccatatattccagttatcataatctttattatttctcttataatgaatatttatagtaatatcttcatattcttttataaatgctctttgaataatactttttggtttttccttttcaccataagttacaactatttcattattttcattatttaaatcagaaatctcatactttagatctccagtggctttattgtcccaatcttgtccttttttaactataattcctagctcaccttctgttacattagccggtaattctagtaacgtatatgcaccttctttatctacataatcaaattcaacaaatttccctacttctcctggataccatgtccaaaatccccagttttcgtattcaatttccccttcttttataaatcttacttttactgtttttttctcttgttgctttggtacaacaattactgaattatctccattcacttctgcattcagtgaatctttaaatgcatcttcccaattatccccttcgtatggtttaaattgatattcatatgttcctggctctaagttaattgttgtagaaaaaataccttgatcgtttttttccatttttatttgtttagatatattccaatcaaccattgatccaattaaatataaagtttctccttcatattcagctctaaatgtcacagtaccatcttcattaatttctggactttttaattctgattcaccttctactgaaatcaatgcattagaagtaaaatcaccttctttaacatgcttaggatttaatgggtctccttgccaatctcccacttcttgatcatttgtgtctggagaccaagttactattccatattcataatttcctggtgcaagatctaatgttacagaccaaatatttgagctactttcatttatcatctcatgtaaaactgacctttcattatcaaaagatccttttactgcaactctcgtttctattccattacctaaataatataatgtaacctttccattactaacctgtggattaactacaactgctggattactaccttttttatatgaatttaatggatcacccttccaatcaccattaatatcatcaatagttgtatctgcccaggtcacaattccatattcatttattcctgatattccctcaactgtggttgtccaaatattattttcactttttatcatatcaattgtattccaaccactaaattccccctttacctttacatcattttctgttccatcaccttgataattaaaggtaacagtaccatcactattaactactgggctttttaatactgtttcagctaaaacatcactcgcactattagaaaacggtaccaaatttatacaaaataaaactaatgtcattaccgctattttccatttgtgcttcattacccctctttttttcataaatttctcctccctattttttaatttaaaagaaaatacttatactacacatctagaaaccgttcccaaacaattgtattatcttttaaatttactttactctcttattgtaaagtatttcaacagtttatttctaccttttttatattttttgtacattttaacaaatatttttccaaattatttattttttttttacttaatgctataatttattatatatgcacataaattaaaggagctatgttatataacataactcctttaatctttaatcgcttcctaagttaatacctaacatacctgaaagaattccaacaactacacaaagtgaaaatttcattaaatcatataatcctaatgtagcttctgctccaaataaaactccaatagcatataaggatatgtaaaataaaactcctacagaaagtcctactagccaccccttatgaccatatagttttgctgcaaatattgttccaaatattaagctaatactggttatagctacataaatagcactaaacattcctgaactaatgtctacaaaagacataactaaagataaaactgctgttaatactgttactactgctactgctcctaccacaccctttagaacgttattaaaatattctttccattccataaaaacacccccttttagttcattctatgagctaaaagggggtattattctttaattatgcaacgtctttgtttactttttgagctatagcatttttagtaattctaaatcttactctatctggccctgattggataaccatttgatcatcttcaattgttatgatttttccaactattccgcctcttgttaaaatttcatcatttacttttaattcagataacattgtattatacttttttgttctcttcttttctggaactattaataaaaagtacataattgcaaacatcgctactaaaggtaatagtgtagctaataattgtgtcatttaaaaatcccttcccttcacattcatcattaaggatacatcgtattatttactatgtattaaataatatactttatttaaaataatatgtcaattctatgaacaaattaaatactaagtttaacaaattattcataaaacacagtttaggattttattttttgcaattccattcccttaacttttgttctttaaactgactataagttccattatcaattgctgttcttatatcttccataagcttgttatagaaatataaattatgtaatacacataatcttaaagcaagcatttctttagctttaaataaatgtcttatataacttcttgtataatgcttacatgctggacattcacatccctcatctattggtctttcatctaattcaaattttgcattcattaaatttatcttaccttgacctgtaaacacatgcccatgtctaccatttctagctggtagaacacaatcgaagaaatcaactcctctatctacagcttctaaaatattttctggtgttccaacacccattaaatatattggcttatcttctggtaaatgtggaactactgcatcaataattctatacatttcttcatgagtttcaccaactgctaaaccaccaattgcataaccatccatatctaatgttgctaagtgtttagcgtgctcaattcttatatcttcataacaaccaccttgattaataccaaaaagcatttgttctttatttattgtatctggtaatgaatttaatctattcatttcagcaatacatctatctaaccatctatttgttcttgctactgaatttattacatattctctagttgaaggatttggtatacactcatcaaatgccattgctattgttgatgctaaattactttgtatttgcattgactcttctggacccataaatattttttttccatctatatgagaattaaagtaaactccttcttccttaatttttctcattgatgataatgaaaacacttggaatccgcctgaatcagttaaaattggtctatcccaattcataaacttatgtaagccacccatttttgcaactactttatcgctaggtcttaaatgtaggtggtatgtatttgaaagctcaacttggcatccaatttcctttaaatccattgaagaaactccacccttaattgctgctaaagtaccaacattcataaatactggtgtttctatagttccatgaggtgtttcaaatctacctcttcttgctttaccgtctttttttaataacgtatatcttttactcaaaacttcacgtccttcttaacttatgtattctattttattatcattgaatctccaaaagagaagaatctatatctttcttttacagcttcattataagcattcattactttttcttttcctgctaatgcagaaactaacattattaatgttgattctggtaaatggaaatttgttataagcttatctactattttaaacttatatcctggataaatgaatatattagtccatccactttgtgctttaacaaatccattttcatcaccaattgtctctaaagttcttgttgatgttgttccaactgaaataatcttatttccgcgcttctttgtttcgttgattatcttagcatcttcttcttccaaatgataaaattccgaatgcataacatgttcatttacatcatcaacctttactggtctaaatgtaccaagtcctacatgtaatgtaacatatgctatattaatacctttttctttaacttcttctaaaagttctttagtaaaatgtagtcccgcagtaggtgctgctgctgatcctttttccttagaataaacagtttgatatctttccttatcatcaagtctttctgttatataaggaggaagtggcatttctccaagttcatctaaaacttgttcaaatattccatcgtaagaaaattcaataattctatttccttcttctattatatctacaactttacatcttaactttccttcaccaaatacaaattcagctcctattttagctcttttacctggcttagctaagcactcccacttatcgccttcaattctctttaaaagtaaaaactcaattttacctccactttcagccttttctcctataagccttgctggcattaccctagtattatttaaaactaatgtatctcctggatttaaatagtttataacatcataaaaatgtttatgctctatctctccagtttctttatctaaaaccattaatctagaataatcccttctttctagtggatgttgagctataagctcctctggtaagtaaaaatcaaaatcacttgttttcattaatatatctcctaaccttcaaaaaaactagtttgcttttttgtaacttttttgccccttgttctacctaaatgactataagccttatccgtagcggttcttcccctagcagttctaactataaatcctttttgtagcagatatggctcataaacatcttctattgttccaagctcttcccctataaaataagataatgtttctatcccaacaggtcccccgttaaaattatcaataatcgcttctaaaattttattatcaaccctatcaaaaccttgagcatctacctctaataattctaacgctgcttttgcttctttaaaacttattaatgaatcagaatatacctctgcataatctctgactctctttaataatctatttgcaattctcggagttcctctagatctcctagcaatttcatatgcgccttcttcagttatatcacagcctagaacaaatgcggaacgtacaattatttctttcaattgttcttctgtataatacaccatatcacataaaactccaaatctatctcttagaggagatgtaagcatacctattctagttgtagctcctattaaagtaaaatgtggtaaatctaatctaattgattttgctgctgcccccttacctataactatatctaaagcataatcttccattgctggatatagaatttcttcaacacttctatttaatctatgtatttcatctataaataaaacatcgttatcttttaatgtagttaatatagcagctaaatctcctgctctttcaatagctggtcctgatgtaatctttaaatctccacccatttctttagctattatattagcaagtgtagttttccctaaacctggtggtccatataataaaacatggtctagagcttcatttcttctctttgcagcagtaataaatatatttaatctttcttttaccttatcttgaccaatatattcattaattttttgaggccttagacttaattcaccattcccatcttccagaatttcatctggtgtgataattctctccaaattatatcacctctatcccattaatactcttaaacattccttaataatattttcaactgattcctgtctatttactttctttaatgcactttcagcttccttttctgaatatcctaaagccaataacgctcctaaagcttctccaatagaatttgcattgcttggtacaatatcttcaaatccttcttggatatcaacaccttctgttacttcatcagttttgattttatcctttaattctaaaattattcttcctgcagttttcttaccaatcccaggtgctctgcataaatgcttatcatcttccataataatagcatactttaaattatttattctacttattgaaagtaatgacaatgcagcttttgctccaacaccacttattgaaataagcaatttaaacatttctaattcttctctatccttaaatccatataagcctataaaatcttctcttactatctgctctaaatatagcataacttcttctgaaacctttggcatctctgtcatagtagcaccagaagtaaatatcttatatcctataccgttgttttctataataacatattctttatttatccccatatacttacctttaatatattcgtacattttatccccctcaatctatataaatagattaaccttgttttgttattttaacgattctcaatttacattgtaaataaatactttttaataatctacattatactttaacattttaaaaagtttttttcaataataaagagttatactaaagtaagagattttagtataactctttatttaactttatcctcttgtatattctccgtatggttccataatatctatagaatcactattgctaaaaacattgtcaatagcataatcatatatattcatatttatattattagaaatcaattttgaaattatctcttctttttcctcttcaaaaatcacttcattttgtatcttttctattatttcaagtgtattatataatctacattctccttcctctactccactcttataacttaaaacctctggaatatcgtcaaagtcttcagttaaatccttataagccccactgacatctctgttaactgtttttttaaaataataagtattaatataagctttagcactttcttcatcattaaatccctttatatttccactaggcataactaataaataatcgaagtttgacataatactcatttcttcgcctccttagtaggttatgataatatttttccctatgattatattgttatacaggtgtgtcttttcctataatgaaagagattataaatagaaaccaaattctatttataatctctttttagtgtaaaagtatattaacaactcattataatatttgagttgtagattgggttacaaatttaaagaattatatttcttcttaaaagtaaactttccctttatgtatgtatttaacgtatttacttttaagatataaaagcagataacttttctatagcctcttcttttgtatcataagaatacttaaaattttttattgcatctaaatcgttaccttgtaagaaacttattggtcgattattgctatatatatcttcactttcttcaattgttaagtttcctgaatcatctgttttatatatagcaaagtatccatctttttctccaagataatatttattaggttgtaaaacacttgttgtgccttcttttataaacaccactttgtcatcttctaaagattctagattatatccatttgcttcataaaaattaacaacaaattgctgatttatatcacttacaattgagttttcttttttaaactctaaaatactttgttccttttctacaacaccttcattcattaatacaaccatcatatcatcatttaaaattttagaattattataaacagttttttcatcatcttctttttcttgcgaatatttcggatttattaatctatcacttataatataagttccaaaaaaactaacaactacagcaaaaactataatacctgctaaaattgaaatttttttattaaagtgcttattttcaaatttcacttcttttttatctttatcatatatttcattactcataaatatcactcctttttctgtaattattgacagctttcataatgatattcacgaataattatttttttattatttttttaccattcgatagttaatattgtacaatcctcttcttttaatgaaatcctatatccttctgataataaccaatttattaattttgtttggatttcttgagattcatcttctattgctaatatagcactaattttatttacccccatatttttccccatgtctatattttcttgaattttatttttatgtctttcaaaatctttcctgtttttattttctaaaaactccatgcccactttcctccttatataaaagtatgattaataaattataatactattttttttaaaatattaactttttatatattattttcttaaattaaggtaataatatataattcttcttgctttatcatataatattgagtataatttatttctgaaatatagacagttcgggaacctcctgtctttaaacaaaannnnnnnnaaaaactaggtaaaaatttattattaaattttaatagataatattttgaattaatttcactattttaacttattatttttttctaaatactatctattatagccttaggttcctaatattttttattaggaggttttttttaatgaaaaacgatatgactaaaagactgactagaactgcaataattgcagcaatctatgcagtagtaactattgcaattgcaccattttcatatggaaacattcaatttagaatttctgaaattttagtgctacttgctatttttgatccactatacataggaggtcttacgcttggttgcttaattgctaaccttttaggccctaatggaccaatggacgttatatttgggacattagctacatttataagtgtatatgctatctattttacaggtaaagtaattaaaaattacaaagtaaaattattagttgcttctatttggccaacattatttaatggtcttatcattggatggatgctaaacaagctatatgggttaccactacttttatctattggagaagttgctttaggagaattagtagtaataactataataggagtacctttattccttgctgcaggctcaagatttaaaaatgcaatgatgttaaagtaatttttaggacaaccttttaaaggttgtccttttttatttataaagcaaaggtcctatcaaatgataggacctctattttatgcagtctcttcttttttattaaaaataacaaatccaacagcaattatagctaatgccataaacataacttgtgttgaagataatggtgttcctgtttgtggtaacttttcaacactttctgtatttgttatagttccttctcctctatcaccttctacatttccatttgaatctggagtttctgaaggagtttgccctggagtaatctctggcttaacttcaacttcttcatcttcaacagtatcagtagtatcttcgccatcaattaataaatcataatttaacttttctattccctttgtttgccactcatttatgattacatccctcatttctccaattattactggatcaatgtgtccatcaaaattatagctatctccaccagtcattaaaaagtcaatacttgttagtgtgtaatattcatcatcttcaacttttgttccatctgataatctcattgaagttatttcatctgtttctgaattataccaaaccgttaaacctgaatactgcccccatccaaatccatctggatttattccgtgctgaattaattcttttaacttggctcctgttaccttcatagtaactacattattatcaaaaggtaatattgtatacatatcacctaatgttaacattcctttagataatggtgctctaatacctcctccatttacaattgctacttgtgttcccccagcttgtctcatggcttctgcaacagtaacaccaagtggtgtaacacctgcatatctatcatggtctaaatcaaactctaaatccactatttcagttgccaaagttggtgccaattcatcattaaatttagatattgcttcatcaatatttgtatcaattgggaagtcattagctgcactttcagcatagaattgtcttgtatttgcctctatacttattatttcattattatcatctacagtaaaagtaagcactgataatcctctaccattataacctgcttgcacaactggaacgtctttaccgttattaatatttgttacaaatccatctacaaatttatgattatgagctgaaataactgcatcaatatcatttgcatttgctgcaatttcagctgcttctcctgttattataccattgctatcttcagttgctggtgaatgagttaatgcaactactatatcagcaccttcttctctaactatttgagaatatttatctaaagtctcaattatatctaagaacttcaatcctactacattttctacctttgtacttgttaatgtttctggagttgcaattcctataaatgcaatattaactccttctacatctgttataatatatggaactgcatagtctggtattgtacctgtagtctcatctattaaatttgcagcaacaaaatcaaatcctgcttcatcagcccaattttttattttatctgaaccccagtcatattcatgattcccaatagctgaagctaccattccaatttctttaatcatttcatttactggcttaccttctaatatatttgatattgctgtaccttgatataaatctccccctgatacagttacaacaccatatgtatcactttcttcatctttagtttgatactctttgattacgcctgttaatttcgccgcacctatattctttcctgattctaaaacatttccatgaaaatcattaaagcttaaaatatcaattactttatttccactatccatttttgattcatcactatttgaaacttcgtctactaattcaatagtttcattagtaatttcatctgcctttgctattctagacggcattaccatccctacacttattgtaagtgctgtaattaatgcaattaatttattattgttttttaacaagtttttcccctccatttgtaaagataattacattttatccctttgttcaattagcattttacattatgcgaatattattttcaacattttctacaatattcgtatatgttatttttttatttatgttatactaaatattttttataatatatttaataatattatcttttcttctttatttatttccaatgatatactttttttatttctcacatcttataattttatatataatacttaatctcaaatactagatttctttattactgatatttccattcattttattgtttatacttatatttctaataaattttattgaaaataaatattaaactattccttttttgaatatttaaaataaaacttttattttaatcaagtaaattatttttttgaataactattatattagttaaataattaaaagtaggtgattaaaatgacattagatgaattagaaattggaaaaactgctactattgtaaaagttggaggtaatggagcattaagaaatcactttttggatatgggacttactcctggaactaaagtttctcttataaaaacagcacctatgggagatccaatagaattacgtttacgaggatatgaattaaccctaagactacaagatgctgcaaaaatcgaaattaaggacgttcatgatacaaagtataccgaagacttaaaggaaagaattaacgatatcccacatccacaagttggtgaaatgggaatttatcatgtccgcaaaaaaggtaatgaattacgagaaagtgaacctattacctttggattaataggtaaccaaaattctggtaaaaccactctttttaaccaattaactggaagtaatcaacacgttggtaatttccccggtgtaacagttgacagaaaagatggaattattaaaaatcatcctgaagctacagtaacagatctccctggaatatactctctttctccttatactgatgaagaaattgtaactagagattttcttattaataatcgtcctaggggaataataaatattgtagatgctactaatattgaacgtaacctttatctaactatgcaactgattgaaatggatattcctatggttcttgccttaaatatgatggatgaagttcaagaaaatggtggtacaattaaagttaattcattagaagaaactcttggaattccagttgttccaatatcagcttcaaaaaatatgggtattgacgaactaatagaacatgctattcacgtagctagatacaatgaatgccctggacgtttagatttttgtgatgaaaaaatttctgatgaacaagctgcaatccataggtgtattcatgcaataatacatttaaccgatgatcactctaaaaatgcacatatccccgaaagatttgcagctacaaaactagttgaaggagatcctattattttagaagctttacaactagatactaatgaaaaacaaatgttaaatcatattataattgaaatggaaaatgaaactggaaaagatagacaagccattctggcagatatgcgctttagctttattaaccgagtatgtgatagtactgttataaaaacccgcgaaagtaaatctcacaaacgaagtgtaaaaatagatagtattcttactggaaaatatacggcactacctgcctttattgctattatagcaattatattttggcttacttttaatgtaataggtgccaccctttcagatttactaacttatgcaataagctgttttacaaatatttgcgatactgcattaacctcttatggacttaatcaaaccgtaaagtcccttataattgatggtatttttggtggagttggaagcgttcttagctttttacctataatagttgtattatttttctttttatcgattttagaggatagcggatatatggcaagaattgcttttataatggataaacttttaagaaaaataggactttcaggtagaagttttgttcctttacttcttggatttggatgttctgttcctgctataatggcaacaaggacactttcatctgagcgtgatcgtaaaatgacaattttattaattccttttatgagttgttcagctaaacttccaatttatgctttgtttacttatgctttttttaataaatatcgtgtattagttatggttattttatatttttccggaattatagttggtattttatttgctatacttcttaaaaatagtgcctttaaaggtgagccaataccttttgtaatggaactaccaaactatagatttcctagccctaaaagcgttgctcaattaatttggactaaagctaaagactttattacaaaagcttttacaattatttttgtagcaactattataatatggtttttacaaacttttgatactagactcaatgttgtatccgattctgctcaaagcatattagctagcattggtggattaatatctcctttatttatccctctaggttttggtgactggagaatttctacggcattgattacaggttttacagcaaaagaaagtgtagttagcacgttaacagttttattaggtggtaatacatcagctttatcaacattatttacaccctttactgcctttgtattcttaatatttacattattatatacaccttgtgttgctgctatagcatgtattaaaagagaacttggatcaaaaaagactgcccttggaattgcagcaatgcaatgtggaatagcatggattgtttctttttcaattcgtattattggcatgctattaggatttgcataaaaataaaagtagctactttttcaattacaagaactgccctatccttccattaacgggcagttcatttataaatatgccttactataatttcaactcaatcctttattatttcctaaaatatcatcctcttctccttcaagttttttacgagcaaattcatctatatctattaacatttgttctttctgtattttcttataaaacgcttccttatcttgctttttattactcataaataatacctccaatataaacttattatttgctatttattaaatattatttaatacctcttagataaaagatacttttaataacattactaaaataacgagaatcatagcttttataaaattattataaaaagctatgattctcgttatttttaagttcttgtatataaattattaaacttattatttactctacctcttcggcaaattgactattatataattctttatagaagccaccttgctccattagttctttatgatttccttgctctattatatttccatccttaattactagtattaaatcagcacttttaattgtagataatctatgcgctataacaaaacttgttctacctttcataatattttgcatagctttttgtaacataagttcaaccctagtatcaacagagcttgtcgcttcatctaaaattaaaatggctggatcagaaattattgccctagctatagttaataactgtttctcaccttgtgatatattcgatgcctcttcatttaaaaacatatcatatccatcgggcaatgtttttataaagtgatgtacattagctattttagctgcaagtataacatcatccttagtagcattaaacctaccatactttatattatcttctattgttccattaaataaccaagtatcttgaagtaccataccaaacatactacgtaaatcttcacgtttcatatccctagtatctactccatcaattttaatagctccaccatttagttcataaaatctcattaataaattaattaatgtagttttccctgctccagttggtcccactattgctaccatctgccctgctttaatttctgcatttaaatcatgtattaaaattttatcattattatatccaaattttacatgttcaaaagaaacatcacctctcggattatccaacttaatagaagtctttttgtcttctatttgttcttcttcacttaaaaattcaaatactctatcaacagcagcaaatgctgattgaattgctgaagacaattgagttacttgagataaaggttgatttatttgccatatatatcttataaatgcttgaagattaccaacagtaattcctccagcaatcgaaataacagctccaagtatcccaatagcagctatccctaggtaacaaattaaagatactagtggccccataatacttgaaataaattgagctttaaatcccgcaacttgaagttcaccatttatagtaataaactcttctattgcatcctcttctttcccatataatttaatttcattaaatcccgtatacatttcttgtactgttccatttaatttacctaatgcatcttgttgctttttaaaatatccttgagatttacttaccactatctttgatactataaaacttagtgggattataatcgttgctattaatgctagcttgatatttattgaatacatcattgctaatgctaaaactactgacaatatagaatttacaacttggcttaaactttgttgaagtgcattagaaatagtatctatatcattagtaatcctacttaaaacatcaccataactatttttatcaaaatagctcactggtaattttcttattttatcttgaactgctcccctcaaatctctcatactattttgaatagcattagttagtaagaaacttgctgcaaatgttgctaatacatttcctaaatatacacctagtaataatattaaaactcttgtaatatatttaaaattaacacttgctcctggtactcctttaattaaatcaaaagaatccttagtaagctgagttattactagaccttcagtttttggtgcaagcgctgtaaatactgctgctacgattataagtaatattgctgttaaaaatcccattttataaggtttcacaaaaggagtaattttatttattgaatccttaatctttaccattatgctaattcctcctctgtaagttgtgataatgctatttctttatatactgaacaattctttaaaagttctttatgctttccacatccaactactttaccttcatctaatacaataattttatcagcttccattattgaacctattctttgagctactattaatactattgcatcagctgtttctttttttagttctgctcttaaaattgcatctgttttaaaatctaaagctgaaaaactatcgtcaaaaatatatatttcaggctttctaactaatgcccttgcaatagataatctctgtttttgacctccagaaacatttgaaccaccttcacctattggttcatcaaactttaattcttttttactaataaaatcgtatgcttgtgcagttttagcactttcaactacttcatcatgacttgcttcttctttaccaaactttatattacttttaatacttcctgtaaacaataatgttttttgtcttataaatcctattttttgacgcaatgctttaattttaaaatctcttacatctactccatctatttttatgctacctcctgtaacatcgtaaaatcttggtataagattaataagtgttgatttaccactacctgtacttcctataaaagctattgtttctccctttttagctttaaatgaaacattttttattacaggctcttctccatctggataagtaaatgttacattatcaaatactaatgtaccttcattatttgtttccgtaactccttgcacagggtcttttattattgtttcagaattcaatacttcttcaattctttctgctgaaacttgagccttaggatacattacaaatacatttgaaaataacattaacgaaaacattgcatgaaataaatattctataaatgctactaattgtccaatttgtagtgcaccaatattaatcattttactagcaaccccaaataatactattattgctaaattgagtaataagaaaaatgatggttgcgcaactgacattaatttaaataattttttcgaaatacttgcatatttattatttgcattactaaatcttttgctttcataatcatcatttccaaaagctcttataactcttattcctgttaagttttctcttgaaattctatttaaagtatccaagtttttttgttgactttgtgaccatggatgagatgtctttgcaattaaaaatacaccaagtactataagtggtaatgttactactaatattaatgataaacttacatttgtttttaatatcataaataaacttaaaataaacattactgggcatatcattgccatcctcaagattgtattagtaaattgcataacttgaaatgcatcatttgtagttcttgttatcatagaagaaatcccaaatttatcgtattctgtatgtgaaaactcttgtgatttcttaaagatatcatttcttatatctctaactacctttgtagaaatatttgcagaagtataacctaataaaatagtacccattgctcccaatactgatattacaacaataacaagtcccattttctttatatagtttatatcattataggctatccccttatctattacctctgccattattgttggtatacctaactctactagagcaaatccaaatacacctaccaaattcagtaatacaagccctttatacttttttaaatatgttaatattaatttcatttttatcctcctttactactttttaatttgattattttaccacaataaatattttaattctacatataatcttattttattacaataaattatttttaatctaaaatatatattcttaaaataataaagactgattgtataaaattataaacttttatacaaccagttttatattcttcttaaatatttatttttttcttttccatgaattccatgattacttttctattgttttcatcaatcttcagagctaacccattataattaattactacaccttctagatttttagaaatagttaaaatatcttcaaaagaacaaatactactctttagcttacttttatcaaaagccttattaaattcataccaatcagtaaatactggaagccatcttaaaccatctttatctttaataactgtaaaattaactttacttcctttttcaagaacatttgctccattactatcaatcccaatattatcattttctaattttattggtaataaaaatttagctcttaaaacctcttcaagcatatttgcttctaatccacgaattacttctgatttattcttataatttttccctgaataagcatattggaaaaaatgtatcatagcaaattgaagctttgcattcataactggaatttttcttgctggtatattactataatcaagtggtggtaatatatcattcctatttatttccatgttatattgtccgttatcaattataactttctcaatacctaaataatgcaatttaccaaattcattcattacatttaagtttattaactccttcatttgtaacaatgtttcttctttattaaaatattcttctgctttatcagcaaattctttttctgaaaatatccatgctctcccttgaaaatctaaatatggatatttagtatttttatcataagcaatatataatttttttgttaatttaagcttattaattaaaactttagtaaatgttataattttagtatcataatcatagttttttaaaatttccttttctttaaaaaccctcattgtataaatcaaaaatacaagctcctgtatggtaacattttcaaattccttgttactatatttattattaaatacaaataaacttcctaattcatcttttcttttattgtccattctttaccctcattcccttagaattaaaattactataacttatctgcttctttcttttttaatcccatttcaaattaacttatacttttatatcttcggtgttttttctcaatataaaaaccattacatagaatatattaccatgagcatgttataattttacaagaaaaactaaagttggtcaataattatgtttaaatcttagttttccttaaatatttaatatatattttcttactttacattcccttttgcatattctctataaaattcagttaatatatcatactcttcttttgaaaagaaattttggttatttctttcatcaacttctttttgagtatatcctaaacttctagccttatttttccataattcaattaaccctaatctaacatttttattttcattcataatatgttctcctttaagcatttattttgccactattatatcacattttacatttactataacttaaacttcatataaatatattattatcttaccacctataattgtacccatacattagaatgtttattttatttagtgtatcttattaatatggaaattattgtggaggtttttttatgtcaaataaaagtgttaatactaaagatattacaaaaatggctataatggctgcattggtgtttgtagcaacatacttaattaaaattccatcattaaatggatatactcatattggtgattccatggttatcctatctgcctttattttaggaaagaaagaaggggcattagcggctggtttaggcgcagcattatgtgatttattgagtggatacatgcaatatacaattcctacattttttattaaagctatcatggttataatcatttgcacaattgcacacaatttaattaataaaaataaatttgcttggattataggctgtattcttgggtgtgcatttcaggtattaggttatgctttatttgaaactatactatatggatttcctgctgcaatcgcatcaatcccaagtagtattattcaatcaattgttggtatagttattgccttagttttagctacagcacttgaaaaatctaatgtatttaaaaaattaaaaaaagtataaatataagcctgttaactcatatctaatatgaattaacaggctatctgttttacatcttcttattatttaaatactagaatccaaatggaattccaaatgcaaagaatcctagtaaaagtattgtccatccaattaagaagcttactgagtaaggcatcattaatcttatcatatcaccaattgtatattctggcttatactttctcataaatactaatattatacctgcataagacattaatggagttattatattagttgatgagtcagcaactctataagctgcagctacaacttctggtgtcatatttgaatttacttgatataacattggtaagaatattggaccaagtaacatccacttcgaagttaatcctccaacaaataagtttattaatgctgtaataagtataaatcctattattaaaagaattggatattctgataaattcatagcttttaataaattaccacctaagtaagtaatataagttccaagtccactcttagataataatgctaagaagttatatgagaagaatgttaaaacaagaactgatcccatagatcccatttgtttagacatacctttaactacatcattagctgttttaaactttccaacttttataccatagaacacccctggcataaagaataagaatgttattattaatataatattatccataaatggtgttacttttgatccatctgcatctataaatgtctttaaaggaccaaaatataatcctattacacatacagctgcaattaaaaatcctaaaccagcaaacttaagagctttattttcaacaggtttaactgtaaagtcatctaagttcatatcctctggaattatataactttctttttcaagtcttggcttaattatctttatagttacaaaagcacctatagctgctaacataaatgtagacacgactacgaaataatagtgcatagtagctggatttaaagcttgtccagcagcgttagtaaaaggaattccttgtccttctgcaaatatcttcgcattattaccaattattatatctattggtgtagctggaattaagttagcactaaatcctgctgaaacccctgcaaaagctgcagccataccaataagtgggtttttctttaaccctgcatataaaagacctgctagaggtattaaaattacataacctgcatcagtagctatactactcatgattcctaagaatactaaaactattggaagcattttatctgaaacttttaatccaacctttttaatcagtgtcgataaaagtcctgattcttctgctaaaccaactccaagcataacaactaaaattgtccctagtactcctccaccatatgctaaccagttattaagtaatgcatttgaaaatatccattgaacattttctgtcttaaacatatttaatatagtatgagttgtataagttccgtcaccattcataacatcgaatgtttttcctcctaaaaagaaagttgccgctaaaacaacaacataaaaaactgcaaatattataactggatctggtattttctttcctatcttttcaatcaaagatacttttttcttttcttgtacatcaattactttttcctctgttctttgttccattttatcccccacgttttttactatcaatctataactaatttagtattatcttactatatcattatcaatttatcaacctttttcgattatttgttgcatttttttataaaaactaattatatattttaattttaataataatttatcgtatctccgcaaatttccctttatttgtgaatttaccctatatcttcacacttaaaatatttttataatatttgctaataaaaaaaatctgaacgtcttttgtccagattttttatttcattaacataaaactattactttataaatgtaactacttcttctatttttttacgtggtggtgaatttggaacatcatcttcagcaactccaagtgctatcattgacattaaattgtatccttctttttcaaagttaataagctcttcaatttctattttagaatgagttggtcctgtcatgtaacatgttccatatcctagttctgtcgctgctaataagaaattttctatagctgctcctataccttgtgctgcggaattagggaattttaactcattaataatatcttcactggcattattatctctaagtattgtctcttctaccatataatattcttttgaataaacaacaactaatactggcgcattcctaaagcaagtataataagaaagtaaattcatcataagttttctttgtttttcttctttagccatttctgctaaatttatatgattcttagttactatatctgctattttattaattaattcattattttgaattacaacaaaatgccatgtttgctgattttttggagaaggtgcatgtatagcagcatctaacattttaataatatcttcttcttgtacgtctacatctttgaattttctaatactttttctattataaataaaatctaaatttttcatatgttatctccttttttattcacttatttttcatcttatttcattatttttcatatgacaatacttttttaaaaaaatttaatattagcatctataaaactattaatttctctcctttttaatttttcatttacatagtaattttgttttagtgaaattactctattacttccaattgattcaagattgcatccattcccccctttataaaatatacaaaaggtgcaaaaaacatatcctttgtcttttacaccttctttcacttaatatgctaatatattgttatttttacatttattatgattagtttaattcattaatgtaactaacatttcttcaatagaaaaaacatgattagtttcaaatatttctgctaagctttcaatattttcttctaaatgctcaatatcctttgaatacatatggctaatatcaactatatccgcatcagtaagctccccttcttcggtaaatcttacaacacataactccttaatcatcaagtaactgactattgctgtttttatctttgcagatacatcataatcaaatactgctttcataaagtatctaaatataaagtaaactaatatatgttcaaacttatacatcttttcttcataatacttattaaaagccttgtgcttaaataaatatacttctttatcatcttcattttgccaaaaatatcttatagcatcatctaaacctaaaggatcattaggagttatatgctttaatctcttaaatacattaaaatattccttcatgctgtaatatttataactttctttattattatatttctctaatttatcaataacatcttttataaaattcctatcaatatatttttctctaacagattttatatctgaaatatcattttcatctattttctcttgaatttctttagtgaaatataatatgattgcagctcttatatttaaatcaatctctctatcttgaataatatctaatattatttttctacattgcataagttctaaataaagctttgcattaatatcattataactatttacttcttcatcatttttatctaactcaaaaatagctttttttgaatctcttaaaattattcttgctgcttctgggcatgatagcgaaattccaacttcacgcaaactgccaaattcctctgtatatcttggatactgtttgcatgtataacaaagtgcctcttccccaacattcttatatatatcacataatttattttcatctaaaaaaggacaattatttccctttaatacaaatatattttctccagcatcatgtactatctcatttcttaatctctccccgaaaggtcctttaaccttttggtacttatcataagtttcgtcatcaataactattccccatccagcacaacatgtatcttcacattttgatgatatacatttaaattctttaaaatattctggtactcttattttcattttctacctcacatcttgcgttattaagcctaaatatctttcagatttcattttaatatttattaattatagtatcaagttttcaataaaaaaagacatctataattataggtgtctaaataacaagtaatttatatattcattttctgcatttattaaattcagcataaatattagcaagagttctattaataaaatcatttgtaacataagcattatcagaaaataataatccataatcactattaaacctactaagcataagaataatataaaaattagtaatacttatatctataacacctgtaaaaagtgaaattactgcattagaatttgaaattacatatgttaaagagggaacaaaagaactatctaaatcataattattatccataactttttttataaactcatctgcattttcatcgtcatgaattcttacactattatcaaaatttatagtccccttctccacttcattaatatataaacctataataaaacaatataaatctatttgtaaatttgcatttgtatttacattaaatgtcgctggatttataggattataattttgattattaaacttcgaataattatatgttaaaaagaaatataatctattaagatttctatatataatttcaccatcttttactaaaggattggggcttcctaaaaacttagcacatggaggaagctcaaaatcttcaaatggattgcaattacaattatttttgcatttcttacttctttttttcttcaatagcttttcctccataattacttcatattattctatgattttaaataacaaaagacacctacattattgtaagggtcttaatttcacaatttaatctattacaactattttattaatgatacatcatcatgcaaaatccctctatgctctactggtgtagaaaatactatctatgtttccatatttccaaaatgctgaagttgtccaataaatatatctaactccatagtagtattaaatgcaacctttatgggcatacaaaactttcccgtgacacaattacattcaattacattgggacatgattctataaagggtttatttttctatttacaaaataaagttttaacttttaagtttctgattttttacatttaacttttattaagtatctatttcaatacacttcatttttaaatattttatttcctaggtaatttttcctaaataagattattctccttaaaaaaatcatgaaaagttttttaattaaaaatattatacatttaatattttaattttctcactgtttctctttcattatcactgatgcttttttgacctttcttgactttaaacatataatatatttgtacaaagaaataagaaatgtacagaaagtcatgattatctaatatttaaaataagtcttatttaatattgtcaacaataatgtaaaattaaaataaatgaaagagagtgattttatgacaatttataattatgacaaacatcaagactacaaatttgaatataaaaaggatcatatcttagttaatcaattaaataaaagtgagtttatttcgccatgttcaaaaagtgctggatttatacttgtataatctccacttccataaactaatacgttttcattaactgtattcttatccatattttcacttggattttctaataccttacttccacaacccatcagtaaaggtatggataataataaagctataaatttacccttttttaccatgttaatttctctcctttataagttattatactttttaatatttttctttcttaaataattgcctatgttagctatacaaataagagttataattaaaaataatccaggaaatacaattccccaccactggttagaaagaactacattttgagctagtgataacatactaccccaagataatagtatttttatatacatcctttataactgacgtaacatcacatttatatttatatgaaattctaaaatcgccttttttaacatttctaacccattttccatattgaatatatataggttcattaagccgtaatttctctattgctttttctttttcttccgtactcattctttcaacggcatttccataataagatttaagaggatctcctggagataatcttgaaatgtaaaatacaactaaagataatataaaaatagcaataatacattgaaatacttttccaaatacaatttttgctccttataaattatattgtctctattgtcttctttacattataatcattcaccaccaaattattatttacaccatctataaaatacgtaattctaatttgctaagctaattaataattaaattatctaaaaaaaacaaccccacgtacatttacgcaggtcttgttaaaaaaatattagtttaacttatcatttatttaaataacattaagacataaataatctaaatcctaacgtctcatgatttatctgtgataattcaatacctggagtattagctccaaaggaatcaaaatcaagttcttctattagtttatagtaatgatcaaatttttctgagtattctttaactaaaagttgaccatccttttgacctaatggtattgctctaacagcattttgtattaaagtcgaaacagtgctatacatatgtaacttaatagcttcttcttctgacatttcaagttcatgcattaataatccaaatactactgcaggatgtccatatacttctttatcagctatttttttgttatatatttttaaactttctatttcatatagatctaaatatatctttatcattctactagcaactaatttagcagcatttctagtttcttttgcaacagtttgtgctattaataagttatcaatttcactaactttatccaaatcaccattttctaatgcttcatataacattcttattgctaatccatcagatgttataaattgatgctttagatataaatctacccatttactaaaacttttaacatcatctatatcattacttcttaaatatgtttccattccgtaagaatggttaaatgatcctataggaaagttagaatcacataattgtaatatctgtaacattttcaaactcttatccatactaatgcttatgctccataaaattaacatgcgtaaaagcattttttactcttctatcttctctagaatagttgatgttatctttccttaattcatcctcaactaaataatcatattgaactatcataacattgtcttcaaaatgtgcaggtagatgtttatttcctaatttatgtgcaatatatgccatttcagttatatccttaggcttaataactaagacatcttcacttttaacttttactataactaaattatggccatcattaaataatatatctccatctcttaatttcatatctctatctagtgatattccatgttcatgattatgatctgatttaactcttattattcttttaactaaatcatcactatctatatatattttttctaagtgatacccatctgtactttctaattcgtctaaatttcctaatatcttttcaaaaagcatagaaagaacctccttatttaacttgatattttattaatacttacgtatatttattggttttaaaccaaataattcttctctaagataatagtgcactgcatctattgccttttgaatttcttgagttaaatttcctaaaattcttattataatgccatgctcttctaatactgaaacaccatattttatatctaaatttaaagcatcgataatccctcttactttttcaacataaatttcattcatattttcatttataactaccattgtcccaaaattaatatatccttctagtattcctagttgagttacatcatattctcttggcttcaattgtaagttatctaacaataaaagtttattatctacgtaaatcttatttttcatctttacagaatcatattgaaatttagatccatctggtgaccaacctgatgttatcccatctgtataaataagagttgcttttttatccatatatatagttgtatcttgattgtatacagcatttttatataagataacactatcagaaatatattctaaaacagaattctcttccattcttataatagtttcttgacaagccgcttctttatttttttcgcatttatacaccttagttggtgcttgtgttgttattattgccttagcatctttttttacttctattgaatttttatatatttcaccttcaacatatcctccacctaagtgaagtagaaaatagcatggtgtcttttctctacctaaaaatattgctggtgaaaccttagatgcacctacaaaatgaactgtagttgcaactgttccattaggtttattctctaaaactaattctgcatttccagctattttattattcatatcgttaatcatattaacaaattccttctaataaacatttttcttttatccacttaataatagtttctattccctcatctgtttttaagttagtgaatataaagtccttttcccctctaaatgttaatgtatcttctctcataacatctaaatttgctccaacatatggtgctaaatctattttatttataacaaataaatcactcttaatcataccttgtcctgcttttctaggtatcttttcaccttgagcaacgtctattatgtacattgaaaaatcaactaaatctggactaaatgtagctgctaaattatctccgccgctttcaacaaatattatgtctaaattagtaaatttattttttaattcttctatagctgcaaagttcattgaagcatcttctcttattgctgtatgaggacatcctcctgtttctactccaataattcttccttcttctaatactgaattttgtaccatgaatttcgcatcttcttttgtatatatatcattagttattacagcaagttcataatcctttgccatctgtcttgttactctttcaattaaaagtgtttttcctgcacctacaggacctccaacccctattattactggtctcataacaaaatctcctttactataattagttaaaaaaatctaaaacctcctaaggataaatttatattcatccttaggaaacttttttagtgtatatgatcagaatcaatatctctaaaagctacttctaaattaacttcatctagcttatattcgatatgagctgattttaatatttcttctattctttcatcgtattgtaatagcattttaccatcttgaaattgagctggaagatgtctattccctaatgaatgagctatcttacccatttctgccatagtatcagccgttacaacaaaaaccttatataaagccatttttatctccataaatatatcttagaataagaagtatctttgagccattggtagtgtttcagctggttcacaagttataagctctccatcaactgtaacgtcataagtttgaggatctacttctaattcaggcatagcatcattaagcttcatatccttcttagttaaatttctaataccgcttacaggtaatatttgtttttctagacctaattttcctttgatatcatcttcaaaagcgtattttgatacaaaagcagcagtagtttgtgctgcagcttttccgtgtgcaccaaacatctttcttaacatttctggttgacatgttggaatcgaagcatttgattctcccataactgaaaggttaatcataccacctttgattactagcttaggcttaactccaaagaaagcaggttcccataaaactaagtcagccattttacctatttctactgatccaacatagtcagctattccgtgtgctattgctgggtttattgtatattttgcaacatatcttctaagtctgttgttatcgttatattctgaatcattttccatgatacctctttggttcttcatcttagaagcagtttgccatgttctagaaacaacctctccgattcttcccatagccattgtatctgaactcatgatactgaatacacccatatcgtgaagtatatcttctgcagcaattgtttgctttctaattcttgaatcagcaaaagctatatcttctggaactttgttatctaaatggtgacaaaccataagcatatctaaatgttctgctacagtgttaactgtgtaaggttttgttggattagtagatgctggtaatacatttggatgtgatgccatctttaatatatcaggagcatgtccacctcctgcaccttctgtatggaatgtatgaataactcttccttttattgcatctatagtattttcaacgaatccaccttcgtttaatgtatctgtatgtatagctacttgtacatcatactcatcagctgctcttaaagaataatcaattgctgatttagttgctccccagtcttcatggatctttaatccacaagctccagctcttatttgctctgcattaacttcaatgttagctccgctaccttttccaagaatacctacatttattggaagtgaatcaaaagattctaacattctatgaatatgccattcacctggagtacatgtagttgcgttacttccatcattaggacctgtcccaccaccgattacagtagtaattcctccatgtaatgctgaatcaactaaatctgggctaataaagtgaacgtgagtatcaattccacctgcagttaagatacatccttctcctgctaaagcttctgtacttactcctacgatgaaatctatattgtccattccatcaggatttccgcctttacctattgcaactatctttccatctttaataccgatatctgctttaaatactcctgtatagtctaaaacagtaactccagttattattaaatcaacaaccaatggattttttctagtttcagttgaattttgacccataccatctcttaaagattttccgcctccgaatttacattcatcaccgtaaactgtatagtctttttctatctttaagaataaatctgtatctgcaagtctaatactatctcctgtagtaggtccaaataaatctgaataatgttttctatctatttcaaaagccattactttctacctcctttagctaggaatccatcaactttattagataatccataaacttttctatttccagctatatctattaaattaacgattttttcatcacctggttcaaatcttactgctgtacctgcaggtatatctaatctcttaccgtatccagcttctctatcaaactctaaagcatcatttacttcatagaaatgaaaatgagatcctacttgaactggtctatctcctctattaataacttttaattctatagcttctaagccttcattatatttaattgcttcttcagctaatatatattctcctggtatcataatttaaaacctccacttattgaataggatcatgcactgttacaagtttagtaccatcagggaatgtacattcaacttgtattgtatgaatcatttctggtattccttccataacttgctctcttttaagtacttgtctaccttcgttcataagaagttcgacagatttaccttctctagcgccttccattatttcatctgttataagtgctatagattctggataatttaacttaatcccttttgctaatcttcttctagcaacatctgctgctacaactatcattaacttttcttgttccttcattgataatctcatagctacatcctcctttataatcatttgtggtcgcattacggcgccattaatgttatatcatttttttgtggacaacgaaactttgatttttaacgttttataccaaaaatatttcataaaacctttatatttaaaattatttttcaaattcatttatttgctatgaaatagtactcttttttgtcgatttaaatattattttgacggataatgcgaatcacttttctcttaatttggccattatttctcataaatgagttcaaatgcccaaatttgctgttttattccacaataattcaatagcactttgccaaaaattttttttaaaaaaaagaaaaaaaattttttcacttttatttaattctgattttagtaacataatataaaacaaaaaaaagattatagtaaataaaataaaaaaagattactacaaaataatctaaaaaaaatcattttgtagtaatctctttgaggtctgttatatcaaaatgttgttaacaacattttgatataacagacctctatactaagttaatcattatactattgactagataggctatggattgtataataatgactcgtccctataaaatctcactttttaaaataacataatacaaataaactattattaaagtaataatagtcaaatctaaaaattatccacaggtacgtaaaaacaattcacaaaaaagcatttttatatgtgaattattaacctctaatattatctcattatattttttaaaatttatccacaccaatgttgtttttatccacatatttaatcccatatttgttgatattgttcttatttttggaattaatccaaaattttgaatcatgtgtagtttaaatatattcttagataaaacatttataaattaacattatacagatataacctttgcttttatccgattccatgataaatatgtattaacttgtgcctttatattaatagaagtattagttctttttataaaaaagcccactcttttataatctatattgtttttatattcaaaagctctccaactcaaataatgatctagatacttacttgctactccattaaatttcttaaaccacaacttagttttattagaatacattttatctatattagtaattttacttttatttaatttcaccttattaatttcattaaatgctttggcaaaagttttaagtctaccatctatataccctaccacataagcatttctatctaagtttggtataatattatttcttattccttgaaatcctaagaaataccttgctgcaattataggaagaatctctttagaatcattgatggcattaacaactataattttatcccgcttttccccatgatattttctatctcccttaaaattttcaagggtaaccatctttgtaagttcaacatatgaactaatcttttcaatataatttctctctttcaaatcatttaaaaatctatgtctccagaaaaaagctgtcactaaagtaatattcatttttgctgcacattctcttaaagttgatcctttaattagaagtccaaaatacgcttcccaattgtctttaaattttttagaacatctaaatggattattactatcattaataaatgttttcccacattcttcattcttacatttatatctttgaattctattgtaaaatccaaatttaataactttatcacactcgcagtgagggcatttattatttctgcttctgtcatcttctacattattaaaggcacaatttttattattttttatctctatgctttctttactattcattaatattttatagatattgttcataatacatcaccagttgtgagtattaacatttttatatatgctaagcattatttttataatctttttatatttcacaaaatttttgtgataaatcacaattttttataaatatatataatttacagttatatacttatagtcaattttctttattatctactgaaagttaataatattagcttaaagtattatgagtctgttatatcaaaatgttgttaacaacattttgatataacagactcatatacagccaaatgcaatactcctaacacttaacttgaactaataaaaaatgcctctaggactaatccaaatatcagattttccttagaggcactcttactattatataccttgatatatttatctaatctaattcagcttttcctgtatataattgatagtatcttccaccttgttctaataaagaatcgtgatctcctctttcaattatttcaccacgttcaagaaccatgattgctttagaatttttaatagtagaaagtctatgcgcaattacgaaaacagttcttccttccataagcttatccataccctcagcgataagtttttctgttctagtgtcaattgaacttgttgcttcgtccattattaaaactggaggattagcaattgcagctcttgcaattgcaagtaattgtctttgtccttgagataaaccttctccatcaccagtaattactgtatcatatccatgtggtaaatgcttaataaatgcatgagcatttgcaagtttagcagctgctttaacttcttcgtcagttgcatgtaaattaccatatctgatattatcagcaattgttccagtaaataagtgagtatcttgaagcactattccaagtgatcttcttaaatcatctttcttaatatccttaacatcaattccatcataagttattgttccagaattgatttcatagaatctattaattaggttagtaattgttgtcttaccagcaccagttgaaccaacgaaagcaatcttttgacctggtttagcaaataaacttatatcctttaatacaattttttcttcattatatccaaagattacattcttaaatctaacatcaccagtaagctctcttaatataggctcatcagttaattctactgctgtttctaatcttgaacttgatatattatcaatactagaaactgttgcagccatttctaatgttgattcaacatctccaatgttattcattttagcagcaacttcagctggaattttccaagcccagtgtcctgtatatttttcagtttcaactaaagttccgtcttccttaacttcaactctagctaaagtgaccttaccgtcatcaacttcaacttcttcatctaaagctgtaaatattctttcagcaccagcaagagctgctaatatcacatttacttgttgagatacttgggctattggatttgaaacttgttttgtatattgtaaatatgaaactaatgaaccaatatcaaaagcacctgcaattgtcattaatccaccaacacaacaagttacagcataattcatatgagaaaggtttcctaacattggcatcatgtatccaccaaatgtttgagctccagttgaagctactcttaactcttcattatgctttttaaaatcttcaattgcctcttcttcatgacagaatactttaataactttttgtccttctatcatttcttcaacataaccatttaatttaccaatattcttttgttgtaatccaaagtaatatttactcttagcaccaaccttacttataacaaatatcattactgctaagaatgttattgttattaatattaagactggacttaaaacagccatcattactattgttccaatgaatgtaagtcctgaagataaaatatttgttaaactgttatttaaagcttcaccaatattatctatatcattagtgtataaactcattaagtcaccatgagtatttctatcaaagtacttaattggtagttcttgcatcttattaaataaatctgttcttatattactaatagtattttgagctacatgaaccataattcttgaatatccataagaagcaatggcaccaactccaaatatagttcctagtaatactaacatcttagctagtccagaaaaattacctggtaatatataattatttactaatggttttaagaaatatgatcctgcaaccattgcaaatgaatttattactattaatatcataactaaagctagtaatgctttatatcttccaacataatgcattaaagtttttattgttttacccatattcttaggctttggaggtcctggttttttgccaccttttcctggagcgccttgtgatgcttgtgcttgatttacatcattttcttgcttagacatttcactcttattcttactcacgtaaacccaccccttcctgttgagatttgtatacatctttataaatttcactattttccattaactcttcatgagttccaattgcacttatcttaccatcatccataacgataatcttatcagcagtagcaactgaattaactctttgggcaattataatctttgtagtatcttttaagtcattagcaaatgcagctctaatcttagcatcagtagccgtatcaacagcacttgtactatcatctaatattaataccttaggttgttttaatattgctctagctatacaaagtctttgcttttgtcctccagatacattaaccccaccttgttctatatgcatgtcatattttcctggaaggatattaataaattcatcagcacatgctgatgttgctgcagcttcgatctcagcatctgtagcattttcattaccccacataaggttttctttaatagttccagagaataatgtgttcttttgaagtaccattgaaacttcatttcttaaagtttcaatgtgataatctttaacattaactcctccaacataaacctcaccttcgcttgcatcataaagtcttggaataagttgaactaagcttgacttacctgaacctgtactaccaataataccaactgtttcaccagatttaatcttaatattaattccttctaagttgttttcatcactgtcatcttcatacttgaagttaacatttctgaattcaatttctccactcttaacttcagttacaggtgaaattggatccttaatatctgactcttcttctaaaacttcaataatacgtgttgcagatgcaactgctcttgaaagcatcataagaaccatagaaagcatcataagagacattaatatttggaaagaataagtcatgaagcttgtaagcttaccaacagttaatgttcctgcataaaccatatttccaccaaaccaaagaatacctataatactagcaaatacaacagcttgcataattggcatatttaaaacaactataccaaaagcaccttcagaagcttgtaataaatcatcattgctcttcttgaatttttctttttccttgttacgtcttacaaaagatttaacaactctgataccaattaagttttcttgtactgtagtatttaagttatcaattttcttttgcatagcttcaaatcttggcctaacatttttgataattaatccaattgaaattataagaactggcatagatactaagaaaatcattgctaattgtggactaattgtaacagataagatacatgcaacaataagcatcataggagctctaactaaaagcttaatccccattgttaatgaattttgtatcattgtaatatcagtagtcaatcttgtaattaaagatgcagtactgaatttttcaatattcttgaaagaataagtttgtattttttcatactcagcttgtctaagttctgcaccaaacccttgtcctgctatagctgaaaatcttgataatccaagaccaaagcataaagaaatagctgccattgcaagcattaataatcccatttttattgtataacctgtatctccagcagaaatcccaacgtctactatttgtgccattactagtgggattaataattcaaaagtagcttctaatgctgcacataaaacacctaatattaatggtgtcttatattttttcatataaggagctaattttttaatcatatatttcacctctttataataattttttaatttttatataaacactatttgctgattatgcattaactcttttattgcactaacttaaaatcagcattgatgttattaacaattgaaaatatagctatccctaaacataatcaataatttaacaatgcatagttagctatatatatacttaaaaataagaggattttactcctccatattctttaatgccctatataataaatctttcaacatttttacttctttatctgtcattcctttaactagttgcttttcaatattgtttgcaccaaaattaaagcttttacatataacttctttccctttttcagttacatgaagacatttatatctagcatcctgttcacttggaactcttgctatcatttctttttcctctaatcttttcactatgcctgttacagttggatttgttaatttcaaacatctttcaatatccttttgaaatacatctctttgactttcatttttatttataaaacatataatttcatgttgtactcctgttagattgaagtccgcaaggtttttattaattttattgataattcttccatttaaaaatttaatcattaatccaacatgctctttaggatcaaagttatgcatttttttatcctcctcaatacatagcatactatgtattttatcactactactttttatagtcaatctaataaggtgtataaatatcacaaataagggtgcctattaccaatgtaattgattaccgctgtatttctttttaattttgagattaatacttgaatttatatccctataaatctcatagttaaaatataactaaactattttatttattcttattccctcatccccaaaaatttaaagatcattagttattattaaaagtaattgaccaaaatttaaaggcctataaaaaaatccactctgtggactatgagttttgctaccctcataaggttatctcctgattttgatttgttataatttgccaaagcataaaaaaagacgggcaaaatctataaacctatagacttccccgccttttcacattttaaaactatcattaattttaaaaatatattcaattaataaaattacttttctacaacttctttagctttaacaggttgtacaatttccttgttgattccaacaagtttcataatttgttcagatctttccttagttgatcccttaattactgaatatttaacattttcagcatctaagaatcctaagatagccttatccaccatttgtgcaacttcttcatcttgccatctaactccatctttcttataaccaaactctcttggtacaaagaaaatgtgatcatattgtggtagatctctgattgctaagctatataaatcatttaagatttcaatttccttcttagttctcgtcttatctccaagcattaatcttccatatatataaggtacaaaagtagcatagtcagttattgcataatcatgtgaatctaagctcttttctaaatgtaattgacctaaataaattccatattgctctgaaattgattcaatcattcccttatctcttaaataatcagtactatattctgtagcaactcctacatttatatctctgatttttaaatctacatatagttgttgaattaatgttgtttttccacatcttggtccacctagtatagcaattcttactggcatcggcaattcctccaaatatttatataaaatttcatttttttattcgtatccttgagaaatttaattataccataactatcatatttttcaacgacaatttttgctattttatgatatacctacatgtagattataccattctataatttatatgtaggcaagtttataaattacattttcttttgctgatcttataaaatttacattgggtaacttttaattacctcaacgtttccttttacaatatattttcctaaagtagctggaattaagtaactatcccccattttgatttcttctgagaatccttcaccttcaatagtcccattaccttcaacacatgttaaaataaagaacttttcttcattactgcaatcaacccattcactttcaacatttattttcttcattccaaaatactcattttcacaaaaatcaaccttagagaatccatcaaatttaacaatttcattattagataaatttgctgcttctaactcaaagttaattacatcaagagatttttcaacatgaatttcccttggtcttccataatcataaactctatatgttacatctgaattttgttgaatttcagcaattattaatccttcacaaatagcatgaactagtccactattaattaagaaacaatcgccctttttaacatcaacaacatttaaataatcttcacatttcccttcttcaattgccttagcaaatacagctttatcacagttttttgttccaacaattaatttagctcctggcttagcttcaacaacataccaagcttcagttttaccaaattgattttcaactctcttagcatattcatcaccagggtgtacttgtacagaaagcttttcccttgagttaattaatttaactaatagcggaaatttttttgtgctaaccttagtaccaactaataaatgtccaaattcttcaattatttcagtaaatgactttccttttaatccaccatttgcaactattcctgttccatttggatggcaagcaatatcccagctttcaccaatatcaccttctggtaaatttgctctaaattcttctaaatctcttccgccccatattttatcataataaaggttctcaaatcttattggatacatcactttactctccttttatatcaaaattccattgcaaacactttgttttcaattcattcccattctatcctatacttacaataaaaacaattgcatttatttactattaagtgactatttttcaggttttatttaatattttttagataaataaagtcaattgctaaatttgcccttctccaagctttcctcttatatccaagtatatttatcacctgtccatcaaataatattaatatggttaggaatatattttcttaggttatcgaaaatataaactgaattcttagcttaaggtgaagctttaacttaatcttaagtagagttcgtttatctagtggcgttcccgttgttatcttccagccaaaaattttggagtattacaacagctagccatcagataaactaaaccttatccaaataaaattcgaggagggataatcttgaaggataagtctaatgtttatttgccacacgtaagaagctactatgatcctgccagcgaatcattagtaaataactcgtcaataaaatcagatacagatacctcaaaatctgaagctgatccaattgtagttaacaatatcgcttatagcgaatttgactatattggcgatatttacgacgattctgatatctaacttagaactacttgccatttaagctagatattaattaaaaggagatatgtcatggctaaaactaatgataagaaaaaaagagttagagggactataccttctagcaataccgaacttcctaatcctctaaatagttttaacagtcctcttggaagcttgaataataagagcaaagaaactattcaacaacaaaacggcaaacaaaactctttgttttagttagcacctcaaaggaaaagcagatacaaaataatcttactattttgtacctgcttctttaagtgatattctaaatctttgatttagttagtaaaacttgcttgaaactccaaatttataatttggttagttgaaaggtatactttagtgtactcctcgactttagtaaatggagtttcctttttcattaactataggttgatagtataaaaataacaaaaaaacttagatacaaattcatatatttaatttgcatctaagctcatacttacattttcaatctatattcattattgtagtagtcctctacttttataaacaactcataagctatccaacttactaaagctaaaatagatataataattcccaacatcaaacctggtaccttatacttaaactctataacatgctcaccttcgctgaattcttctgtatcaacatctacaccaattaatccatctaatatccttgcatactcaacattcttaccatcaatttttactgtccatccttcatcataaggtatagaagtgtatagcaaagtcttatcctcagtaacatttatattacctttaacataaccatccctataatcagtatcactaataatattttcctttaaattattataaacttcttcaaattcatcaacatcacaagaataaatttgcaattcctttaaatatagtttatttgtatttaaattaatctctattcttatatcttcacccttattaaattccccgatatactccacattataatttctactatcaaatgcagtaaattttctaactccattaatagaaactcttacttgattgctactagcagttccactttcatatgcattagattttaaaaacatataaactggattattatcttccgcctcaactacaaatgtaatgcttgcttccttttgattatccattcttttataacatacttcgccatcatttatagttgaaattaaattttcagatgttatttcctttatgcttaacgatttattaataacctttttctcatttaccattgaacttaaaatgctattattcaattcaaatgtattaacttctgtagtagctacattcttcaaactatcattaaccatgaatgctataggtaaagcaagtggattttcataaactatataatctccctcttctaaaaacttcttataatatctattttctgtatagtgattatcagaaaagttttcagatttttttgatactatttgatatttaactcctaataatgaatctatactaataagacttcctctattatatttctcgaaaatactacttgtcttaaaccccatattagtcataaactttcttgtatttctatcatttgctgaacttgaatgagtaataccataataatttaatagcattggatcatcatacgtattagcaaaaacttcttccattctataaaagttatccatattatcttttaattcatcaactattggttgcatttcattaatataattatatatacgtactcttgatacatagcttttcaactttaaacagctatatgcattaataattaattctataaaaacaatagccataattaatatatttatgatttgtcttacttttcttctttttaagtaccttagcctttttctattattatcaacttttccacactgactatcacttatagatttattgatatacctaacttcaccttcagcacatctattaaatttaactattttatatagccatggatataatgatagactaaaattccacttctcatacttattaagattaatccaattagctaacttaatcaaaattatatagactacaaaaaataaaaatgttaataatatgttccattgagataacccttcataatcaccatataaaatatatcctgtacataccgtacctaataaaattattatagctatttttaacttcgatatattttcaccacttataaactccttataagctaaaacaattcctaaaaacgatattaaaaaggaaaatctatatgcaaatcctactggataatcaaacccatgccatattaataccaacatactaataaaaatacttaataaaagtacaaacataaatattccagataaaattctctccttcctacttatgttcttatttaaaaaatataatatccctaatacagttataataactccacaatatatattagcgtaatttcccattatttgtcccaaactatagtttccaataaaaagctgggcaattacttcatctaaactcatcattaatttaggtgattcttgaaaaatcctaaactttgcttttcctgaacctaatgataataccgttggaataagtataaatgctgataatgcaactgataatacagatgcacctataaaatttcttagctttattaaagcaaccttatctagctttattaatttaaccttattatttaatattaatttatagataaagtacaatcctgaaaaaatacatatcatatatccaatataataattcgaaactattgctataaataatgatattacatatagcttatacttattttcatttataagcttgtctattcctaacataactaaaggtaataaaacaactccatctaaccacattatattaagttgaaagttaatattatatgccatgaaagaataacataaagaaaacataattacatttatatcttttttcttaaagttttcaattaaatatattgtaaatgttaatgaagccaaacctatctttattaatgttataactactatagcctctgcaatataagcctttggaaacaatcctataattaaatttaaaggacttgccatataataagcaaaaagccctacagtatttccccctaaactcttactaaaactataaaatagatttgcctcaccttttaatacatcttttatatgacctaaaaatccaacatattgtgagtacatatcactatttactatagtcttatctcctactgggtatatacctattagaacataaattactaccattaacataataggaacaataaatgagaatatataaatataattttctttaagctttaattttaacttcttcatccacttcaatttccttgttatctagtattttttcttcttttactatatataatggcctttgctttgtttctaaatatacttttcctaaatactgtccaagtattccaaaaataaataactgaactccgcttattaatactgtaaatactattaaaattaaacttgttgatatatttacatccatcatcaagtacttaataattaatgatactcctaacactgttcctattaagcatagcaacgcccctattactgttaaaataattaagggaacagtagaaaatcctattattccatctattgaataagtaaataatttgaataatgaccatttacttttacctgcaactctattaacattttcatgtcctatccatttaacattaaatccaacccattgaaatattccctttgtaaatctacttttttcttctattgaaagtacagcttcaaggaattttctattcatcattctataatcttcctcaccttgcataaaatcaagttctgtaatcttacttgcaagtttaaaaaagatttttgaaaaaaaatatcttattttactttcaccttttctatctatcctataagctactacactatcatatccttcttttgttattccataatacatatcctttattaatcttggtggatgttgtaaatctgcatctattataactacatattcaccacttgcagctttcaagccagcatatatagctgcttccttaccaaaattccttgaaaatgatatatatttcactttactgtccaattttgaataaccttttattatttctaatgttttgtcttttgacccatcatctataaatattatttcaaactttacctttttcatttcagaggtaactttcgtaatctcgatataaaagctttttaatacatcttcttcgttatagcatggcactacaacagttattgtatccatgagattaatacctccttttacttgcttattgctttatttacttcagaccttagttcatctatacctttaaatataaatactttactaaagataaaattaattactgctactaaaattcctataatcagtttgcctacaatatcattcattaaaagtaaatctacaaataaaaatagtaataatatttctgctaaacctgaagctaatctgcagttcataaatcttatgaattcttctattattacatccttatttatatcagaactattgaatacaaaaaatttattagttatatatgcaaatacaacagatattatccaagcaattgcgttgcttataagataatttatatttataatatttgaaaataaataatatgctattaaattaactattgttgttagtattccgaatattacatataaaattgtttctttatttattagcctttttatattattcatttttcctccttatctataattgctaaataattatatatctatttacaattatttacaattaatcaattagtagtactactttttattaattttgaaatactgataaagaaaaactatttatatttacttatgtaaccgtcattaaggtgtttttatattattatattagggagattgtttattagggagattgttcgctttgttaatttataagaaaggtgttttcataatgataagcttatttattaatgaccataaagtaatattggattatttaaataaggcattcacatttaaaataaataatatacctaatatatttttaataaaaatttgtttatgttagttagcgcttatttaaatcttatacttttttaccataaaatttatatcatttaattactatttagtattactagtcgaaatcgatatcaataattcttagaatgatttttaacatttaatgtaattattaatagacttttacatttctttagaatataattttagtagtaattactttatatatgaaaagggtgataaaatgaagatttctattttatgtagatatccagtgatccatgaaggtattaaatcgatattaaaaactaaatatgaagacatcacaagctttacttctatagaagattgcttaaaaacattagattctacagaaaatcaaagcttaattaataccgaagatacaatcttaatagttacattatttaaggaagatttaaaaataatagataacattttagctattaaggataattactccaaactaaaactattaattatagattttaccgaaagtaaggacatgttctttaaagtatcaaagttaaatgttgaagggtatatgttggggacatttgctcaggaagacatcaattatgctttacataagatttcaactggaactaaattttacgatcgtgaattattatatagacttgttgaagatgagcctgctgcaacaattactagcaggaataatttaggttctcctcttacaagaagagaattggaaatactttctcaactatcaaacggattaagtaattttgagatagctaaaaatcttactattagtgaaaatactgttaagaagcatataagtaatatatttattaagattaatgttaaagatagaactcaagcaatcatttatgcttatgaatctggtttaattgctaaaccattattcttataaaagacatttgctcttaagaacacagatataaattaataaaagactatttaggtgttcttaaacaaatttaaaggtatttcctttaaactttaacttagcgtttgcatatatttatataaataagtagtgataagtctttcatgtagttttattactgcttattttttatacttgtttgcatattaaaaaggactttgaagctattattatcgtattaaaagatagtcctttatcccctatgacttgtttttcaagtgcatcatacataattttgttatctcctgataaatttctttatcattttaattgcagtatgtttaaatgaaaatatccgaaattatgcttaatattattttcagtaatattaaaatacaccttgaaccatcatgttcattcataaagcttttcttcacaatacatttttacatccaaagaatcgatattttctcaatattataaaataaagatacgctatacctatccttgaactaatagctcaaaatccttcaaagagataacactatataaaattttaaaaacagtagtgaggcataacaaacatattatgatcaacttccatttcaatatttaataagcccttagcatcacgcttattaaatattaataaattttattctttgttacctcttattattgttttatcctttttaaacttaatttattcatatttttttagaatttttcacaaaaagttaaaagttttgtttatggttgtatatcttttctcttctaggtaagacttcgtaaagacttagctaggcctagagttaagaattttattttataggagttactaaatgttaaaatataattttaatttagaaaagctaaaaaagttatttaaacttaaaagaaatgataaaaaagatgggtttactttagttgaacttgttgctgttatggctattattgcaattcttgctgctgcatttattccaaagttcggaaattaccttactgaagctaaaaaggttggtattttaaatgaagctaaatccatcgttactgcttacgaatctgttaaacacaaaggtaagtttgacgaatcttctattggttcatcatttgaaggtaccaatttaccattagaaaccggtactttaacaaaattaagcactgctactgtagaacaatgtaatcaaattatagatactgaaacttatgaatttactataaataatgataatactttatctatttataaagatggggcagtaataggtaagcctatatccattggatcatctagtaatgattctaatgattaatattgtatttatatcaaaatcatatttataacttttgaaatgctttaacctaagataatattattctaatttaagcttatacaaatttaagcttatgcagacgcttaaattattcataatagaagaaatatcatttatttataatacaactactttcttaattagatttttattattagatttaatttttgtaatatttcacaactcctcaataattgtgtaaaataacaaattaatttaataaacaattatttaaaaacaataataacttgttcaacatatattataaaatctaaacagcaatttatgtaataatcattaatgtaatattataattttaaatggactaatacatatattaatttatagactaatttttataaaaattttttttgcagaatatatatttctgctattttcaaaaattattaatatttcctaaagtgatcaataactttttagaaaattgtattttctaaagaatacaaaagctgtgtctaatctactgcaacattaatttttttaatatgcattgtagctttgacacagctaacttaaaatgtatttatatcataaattataaactaaagaattctgtaaatgccttaacagtataatagttatccttaacacttgctaactctcttattgagtgcattccaagtaccggtgctcccatatcaattacaggaatagttaagtttgcagctgttacaggccctattgtagttccacctctaacatctgatctattaacaaacttttggaatggaactcctgcagcttcacaaacactcgcaaatacagctccattaaaactatcagtactatagcttcctgatgcagctatttttaatactggtccaccctcaagaactggtctatttgtaggatcatgtttatcccctaagttaggatgaacagcatgtgctaaatctgcagatatcattatagatttagctaaagttctatagtatccttctctgtcttttcctaatccaagtgtaattctttctaatatattatttaataatgtagaatcagcaccttcagctgttaaacttcctatttcttcattatctatgcaaatcataaccttagttgcagcattttctctgctattaattaatgccttaactccagcaaataccatccataaatcatcaaatcttcctgaagagataagttcttcattcattcctattaatgatcctttttcatattcatataatccaagttcaaagtttagtatatcctctttattaacttgtagttcattagcaagaatattcattaagtaatcttctttttctaatttatcatttataagtcctaataaaggtaaagtatcaacttgcttattgattttatatccttcattaacctctctattcatgtgaattgctaagcttggaattattaataatggcttattaatgttaactagtcttatttctggctttaatggagaagctccctttaatgccaccttaccagctattcctaaaggtctatcataccaagtatgaagtattggtcctccataaacttcagtatttaacttaacatatttaccttcactaatcatttgtggatttggttttattctaaatcctggtacatctgtatgtgctccaataagtcttaatccagtttcttctatatctccagtacctacttcaaaagcaattaatgctgaatcattttttacaacataatatttaccttttggttgtaagttccatttatcttcttcttttatttctacaaatccatttgtatctaatattttttgagtagccttaactccatgacaagcacttgggctatcatataagaagtctattaattctaatgctagattcttttccatagtcatttgctcctttacttgttgtatatgttttactatacttcatttgctattttttctcaactcatttaacttaatatgaatcctttatttaaagaaaattaataactcactttcatatataaatccatttaactagattaaaattttaaaatttacttaaaagtaaaccactatttactcacgttaattatagtaattttattgattaaattgatatttgtatgttcatttaatattactctgcttctgttataccaaaatgttgttaacaacattttgatataacagaagtatatattaatatttttagtaatctaagatcctataataaattttaaatatgctaatttataataatattattatttttctataaccaatttacatactttttacaacaatattttggtataacaaatcttcatgcctttaccaacaacattttgatataacagtcctctatagtactatttaatactttaataaggtaatcttaattcataactaccactgattgtcatccttccaacatgtaatttattcccctctaaacttgtaattatccatagttgacttttatattatattaaattagcataatataataaggcgtataaatggaaataatatgttttataaaaataaatattttattatataaatttataaaaataactatgggaggattcttatgttatcaaattttttagtaaaaagatttgttaaaaattctgaaaatgtatcagatgttaaagttagagaatcttacgctaatcttgctggtattattggaatactaaccaactcacttctttttttaattaagttatctgttggtttactttctaactcagtttcaattttagctgatgcatttaataacttatcagatgcagcttcttcaataataactattgtaggctttaaaatggcaaataaacctgcagatgctgagcatccatttggccatggtcgtatcgaatatataactgcaatgatagtttcatttatggttatgcttgtaggattacaatttgtaaagagctcatttcaaaagataattaaccctactccagtaacctttgaaatgataccatttttattattacttatttcaattggctttaagttctggctatctaaatttaataaatctataggtaacaaaataaattcatcaactttaaaagcaactgcaactgatgctatgggtgatgtttttacttcaagtactgttgttatttcttttttaatatcaaagtttacaacacttcctattgatggatatataggtataattgttgctttagctatagtttattcaggattttcgcttattaaagaaacacttagtccacttttaggtgaaccaccagatcctgctttagtaagtaatattacagatatggttatgtcttatgataatattactggaatccatgatttaattgttcataattatggtcctggaagaattatggcttcaattcatgctgaaattcctagtaatattgatattatggaaattcatcatattattgatactgctgaaagagaaatttctaaaaagcttaatatttatttagtaatgcatatggatcctatttgtgttgatactgaagaaataattgaagctagagaaatgattgaaaaaatacttcacaagtatgatgaagtaaagtcttttcatgattttagggttgtaggtgatcatgataaaaagaatcttgtatttgatatagaagtatgtccaacaaaacttactcattcagaagatcatactaaattattatctaaaatagaagctgatgttaaagctgaatctcctgaatatcgttgcgttattactattgatttagccctataacatgataacttgatatataatttgtattttttgtattttatcacaatataaaatcctgttatcgcatgttataatttaattatcttttgatgttagttaaaatttttattcatatactgtttgtagttatttaattacgacagtcccatttttgcttataataagaatgtactaaaatacgatttcgttacatatacttcatataagcataaattattataatttactcatattgattaaattataaattcctcaaaaatagacggagaaatctattattagatttctccgtttattttttatttttaaatgataatactttaaaattatattacgaatttaatacaaaatcatatataataaaactcatattccaattatattaaatttataagatcaagtaaattttattaagaagttgaatcctactttaaaacataaaaagtaggattaatttttacgttatttatcgcaattttcatctctattctaatttttatcgccattctaatttttatccctattataattttttatctctaatattgcattttatctatttatatattattttttgtatttttatccaatttattaattgactaaatattgatataatcaatatgtaaagcatttaattttttggctcttatttctctgagctatagatatataaatggagaagtctaaagctgtccttctccatttattattcttagctaataatcaatttatagttatactcttaacttttcaaattataatataatttatcttcaactaattgatgatataacatctcatcttctggttttctttctgaataccatttaattaagtcattgataacatcatatattccactattaattagtttacttaactttttaagaaccattaattcttctattgttactatcttactctcttcatattccttaagcttttcctttaaaaatacatactcacacttactaactcctaaagcttccccctgcattgcaatattgaaagattcttcatacttcggattcttatataaatcatttttatataaataaaatgctagctgtccatagcattctagatttccaagctctattccctcctgatataaatttattatttcatcactactcatttcaattaaattattctctgctaaataacctctaataaagtttgcaacacctttatctatttcttcgatttcatttattaattcataccctttttccttgttttcttcaacgcctattcctttaaagcagtaatatgcaagtctttctttaccctttaaagcatctaaatcaattaatttaaatacatagtaaattgctttaatatcacttcttctaccacctattcctttttcatatatttgtataagattttcaattccttcaattccatttttattagcagccttttcataccatttaatagctaaatctatatttcttgataaaaatattcctctcttataccaatctccaagcttaatcattgccttaatacaacttctctctgctgcaatattataataactataggctttctcataatcctgtggtacccctatccctttttcatatatataacctaacttaaagattgattccttaagatcattttctactccaaaattaatatatttaactatttctgatttatttacttttttaccttcattcacctcattaatcataattgacgctaaataatctgcagcatatggtgaatttaattcatatgcttcctttaataacttcttaactatatcagtggttttatctccaaatttatttaatcttaagtatgcaactgcaagtacgtacatagcatgtggctcttttttagcagcggcaatactaacatattctattgctctttctaaatccttctcaacaccttcaccattgtaatacattattccaagcctttgagtacactttaaatttccctcttcatgaccttcttcatatgcactaatagcttgattaattaatccctgttcttcatataacttaccaattttaaaataaatacttttatctccaaattctatagctttgttataaagttctatagcagtataaacatcttttttaacatataatccctttaaatacatctctgccaatgattctatacaattagtatctaacgctagatatcctttagataaataataaaatgctttcttataatctgcctctaggtatatcccctctaaatatgatcttccaacaatataatatgcatcttcatagtcattttcagcagctctttctacccaataataagcacttactaaattttcttcacagccctcaccattcttatacattaaagataatgcatattgtgatgcagggaaattattttcagcagcttttttatgccacttaaatgcactatctacatctttatctacaccaagtccattataataacatcttccaagctgataatatgcagcggcataatcattttcagcacttttttggaaccaaataaaagccttataataatcttttggtactccattaccttcagaatataatacacctatagaatattgtgcaaaggcattacccttactagctgctttataataccattgatatgccatttcgtaattcctagctattccaattcctctatcataaaataatcctaaataactttcagcatactcatcattcatttttgctgcatcaagaaaatacttatatgcagttttataatctctctttactccccttccaaagtagtatttttccccagcctcaactaactcctgagaagcttcttctgcttctgttttatctaaaatattacttcctatttttttcttattttctaaagcagtcttgtccttttctagatatttcttaaatatttctttttctgattcaaataaatcacttataaataaagaataattctcgttaccataattaattacaaaccagacaagcacttcatataacagtttcatttcaagaatctcttgatcattttcataatcgtgcttattacttttaacctttttactccacaatattattttttctaatatttcatcaggaataacatctatttcttttaatatatctaacctttttagccaccctatattttcatcatataatatattattttgtttacatatataataaataatatcatcaattacagcatccacatctttatttatcatctctggactagtttgtccttttaattcatttaaatcttcatatatatctctaaactccaactttagaaaatcataactaaagattttgtccatatatcctccaatgttattactcctactaatagtttattatatggataataggtttattagtagtattttttaataaataaaaaaatactagctatatcaaagaaaagttcattactgaaaacttactttgatatagctagtttaattaaactataatacttttgataaaaagtctattgttcttgagttttttggatgtgagaaaatctcttcgggagttccttgttctactatatttcctgcatccataaataaaattctatctccaacttctcttgcaaatcccatttcatgagtaacaactaccattgtcattccatcctttgcaagatctttcataacacttaatacctcaccaaccatttctgggtctaatgcagatgttggttcatcaaatagcataacatctggttccatagctaatgcccttgctattgctattctttgtttttgtccacctgaaagtgatgatggataagcttttgccttatcagttagtccaactctttctaatagttcaaatgccttcttttctgcttctgacttactaattcctttaactttaacaggtgctatagttaaattctctaacacagtcttatgtgggaaaagattaaattgttggaataccattcccatcttttctctaatcttatttatatcaacctttttatcagttatactttttccttcaaatactatttctcctgatgtaggttcttctaataggtttaaacatcttaaaaatgtactttttcctgatcctgatggtcctattacaactacaacctcacctttttttatatgctcatctattccctttaaaacatcattttttccaaaacttttatgaagattattaacgtgaatcactttttttcattctcctttctataagagatataactctacctaatgtgaatgtcataacgaagtagaatcctgctgctactatgtatggctctaatccaagatatgtagaacctacaacaacctttcctgcaaacattaattcattaacaccaatgattgaagccattgatgattccttaattattgcaacaaattcattacctatagcaggtaagatatttttaacagcctgtggtattacaattaacatcattgctgtactctttttcattcctaaacttcttgcagcttccatctgccccttgtccactgcttctataccagctcttactatttctgatacatatgctgctgaatttaatgcaattgctataattgctgatgcaaatggacttaaatctattccaaaaaacatcttagaccctgcatacataattaggatttgtaatagcattggtgttcctctaattatttcaatataaacaaccgctattatttttaaaggctttatcttccaaatatgaaaatttgatgtcttcataaagaataataaagatccaaatagcgctccaaagaacactgtaattaatgaaattaataatgtatatttaacaccttcaaaatagtaaggtaaataattcggcacgaagctaaaatcaaaattcatttcttatcctcctcaattttaaatgtaatcacttaagttacataaatatttatctttttaatataataaacttattaaatatctaaaaatataactcttaattatttaatacttacttttgcaaataaatttttaccttttaaaatttctgtattactataaactctccataaaatcttcatagtaatatactaaataaaatttactatttagcagtctagagaatatagttatatactccaaactgctataactaaattctatccttattattcagtaactccagcgcttgctgctaacttatttgcatttaatatatactcgtccatttttcctgattcatttaattcatttataacttcatttattttagctaataattctggattgtttttagccacacctactgcattaccaccagatttatcttcataagtaggttcccctactgataaatctggattactgttaaccgccatttcagcaactggtttttccattattattgcatcaacttttcctgattttaattctaaaattaaattattaacattagctagtaattgtaaatcagcatttggaatttctgattttgctattttctcttgagttgatcctaattgagccccaacctttgcaccttctaaatcagcaaatgttttatacttgtccgcatcttcagctcttactaatattccatgttttgagttataatatatatccgaaaaatctacaactttagctctttcttcagttggattcattcctgaaattacaacatcaattttccctgctggtaatgctgatactaatgcatcaaagtccatctcttgaattactaattcaactcctattgcttcagctatctcattagcaatatctacatcaaatcccccaacaacatcttttccattttcatctatgtagtggaattcatatggtgcataatcagcactcattcctacaactaatttacctttttcttgtattgtttctaataaatcagtactattctcatctgatgctttgctgcttgatgccccacatccaacaaagcccatagtcattacacctaacattgccgcagctattacctttttcattaatccttttttcatatctaaatccccctcggtttattcattgttaatattattcttgtcctcggtataattatacatcttaatattatatttatgcaatactatttttgatttttttatgaatttttatatttatgcataattattatacttttaatgaatatttacgtatctttttgaattttataattatttcatacatttttaaagcagcttttatgcatatatatttatatttttattttaaaatagcaataaataatatttaaattaaattattttattaaatttgtctatttttatgtccatcatgaataaaatattatgaataacttaattttattaggagtgaaattaatgacaatacaaaaagagagacatctctttcctggtggaaacacctctaaaggcttctattcattttatagatatgtactttctcaagatgatgcaaaacgtatactttgtataaagggtggcccaggtactggaaaatctcaacttatgaaaaaaattgctgcttatttcagcaaaaaaggatatacaatagaataccatcattgttcttcagatccgaattctttagatggagttttaattaaagaattaaacatagctttattagatggtacatctcctcacattgttgatccaataaatcccggagctgtagatgaaatactcaatatgggtgatgccttagatatggatgtgctttctaaaaataaaaaggaaattatctctttaaataaggaaattggtaagaactttaaaagagcttatagatatttaggatctgctaaatgtattcatgatgattggagtagcctaaattacgaatctttagattctaataaaatttctaatattattgaaaacctaaaaaataatatctttaagtctgataaaattggatatggtggcgaacgtcatcttttcgcaactgcaattacccctgatggaataatcacttatgctgatcagcttagtagcgaatttaagaaaaaatatgtattaacaggcggaccaggctttggtaaaactgatattttgaaatttataggaagtagtgggcaaaaaaagggcttctttgttgaatacatgcatgatccttttgttcccgaaagaattgagcacatttttattcctgaagtatcaacctgcattataagtaataatgaaattaaccaagctaattacactggtattgaatataatttattcgactatactaaatctaatttatcaccttcaaaaattgatgatataaaatataatagtgatctattctatcaattagttaataagagtatttctttaattcataatgctcatatattgcatgatgaattagaaagttattatattaaggcaatggatttttctgttgctaatgatatttatgataatgttattaagaaattaagtaaatacgaataaaaaaaataggctatatcctttttttaggatatagccccatttactttctaatctaaatttatttttttacttaatagttatttatataatttattttcatagatttaatataatacaaatctccttatgctaataaatccataattcctactattcctttatccctatatgaatctgttatatcaaattgttgttaacaacaatttgatataacagagctgtatagtatttaactattacactcttatcttatctctcactataaatttcatcttatacattctataaaataataaactttcaaactttagagcatcataattaaaccaccatataattaaaatagcagcctattaatcagtataatatacaataaaaactcttcattattttttaattatataccaatactttattcttaaaattaagtttaattttacacttctaattcctttaactttattgagctccatgtaatatatgtatttatttctgtgcttaaattaatatttaattctattctttcttcaattgatatatcacttttatattcgatattatttttatattcaaaagccctcaaacttaagtaatcacttaaatatttgctcgcaatacctctaaatttttttagccacgatttaactttaatagaatactttctatgaatgtttttttcaatctcctgatttagctcattcctatttacttctatgaataatttacaaaagtaatcaagtcttgcgtctatcattccaactatataagcatcctcatctatacgttctattaatcttttctttatttctctaaatccaaagcaccttctaccagctataactgaaattatatcaacagaatcatttacaccattaatggttataattttatctcgccctttagtatttatatttctactccctttaaaattctcagttgttactaacttagtaaactctacataagaatctattctttcaatatgatttttcacccttaaatcatgtaaaaatctatgtctccaaaaaaatgctgttactaaagtaatatttaattctttggcacattcccttaatgttagtcccttaataaaaacctcataatatttaccccaattctccttaaattttttagagcacctaaaaggagtattactctccttagtaaaagttttttcacatttactattcttgcatttatatctttgaatccctttataacttccaaatttaataaattcattacattcgcaatatgggcacttttcacttttatcctcaattttatttgagttcactttctttataagtttattatttcttctctgatttataattaattttttatatgcatttctcataattcatcaccagttatgattattaacatatgacttcaattctaaaccacattattataaactttgctgatttaataaaagctttaatattaaaaacggatggttacttttaaaccatccgtttttattaatatcatatatttattttctcaaatcttcatttttaactataacatcatatcctgtgtaagctaatgctaacgctgctactaataatctatcatgggccttatctgtagttgtagtatcagccatttttgttgtatgtcctggtaacggacaatctgtcaatcctatatatggatgaattgttggcgctacatgacttacattacctatatcacttgatgccaagctcttttgtggagcatttatttctgtaattcctaattcccttaagttttcattaaacatttctgataatgtttcattagtttttaaattatcatatggtaattcatatctatccatttctaaagttgcaccagtcattaatgctgcaccttcagcaatttttttaactttttctaaaacatcataaactttctctttagtttctgctcttaaatagaattgtgctactgcttcatctggaactatatttgcagcaactccacctttaacgattattccatgcatttttacatctggagttacatgttgacgaagtgcatctattccattgaataattgaataacgctatttaatgcatttattcccttctctgggcaagcagccgcatgagctgttttacctctgtatgtaaattgaattgcatataatgcattacttgatccgcttgctcttgtttctcctgctgggtgtactatcatggctgcatctaattcatcaaatgctccagcttctgttaaaataacttttccaccatttgtttcttctgctggtgttccgtaaactataactttaccaccaatttcagataaaactttacttaatgcaactccggctccagaagacatagctcctatcatgttatgtccacatccatgacctatttcaggaagcgcatcatattcacatagatatcctactgtttttcctggttttccaccatcaaaagtagctttaaatgctgtattcattccagcataaggacattctatttcaaatccatgctcttttaagaatttagttaacacctcaacagccttgtactcttcatttcctaactctggattattatatatataatcacttatttctgctaatcttgctttaattaattgaccttcattatatattctttccttcatttattcttcctcccttgtaaattaaactaaaaaataatccaaataattaagagttagtaattttaagttagtagctaaggataaaccccttaaagaatcttttaaaaatatatttttaaataacatatttttaaaattcatctgaactgaatttattcctaaccttctaactacaaactcctaactcctaattaataactaaactaagcccatcccatcatcattgcacaagttacaaatataattccaagtgcaaataatattatttgtaatggcataatccatttaacccattttgaatatggtattcctgccattcctaagcatgccattaatactcctgatgttgggaagatagcatttgagaatccatctcctaattggaatattaaaactgttgtttgtcttgatatatcaagtaaatcaccaagtggtgccaatattggcatagttaatgctgcttgccctgaacctgaaataacaaagaagtttataaacatttgaactggtaacattacacatgcagctaataatgatggtaatttacctatgaatgatgataaaccatatagtattgtatctataatttgagcattttcagcaactataactatagctcttgcaaatccaattaccatagcagctccaatcatatccttagctcctgctataaatgcctctgccatttcatctgcttttaatccaccaactattcctgcaaatattcctgttattaagaatacagctgctatttccggaatccagaatccttgctttagaactccccatataataactgctaaacaaacaccaatagatgcaatgataattttatgtgcaactgtaaatttaatttcttcacttgtagtttcacttaattttttacgtttttcttcatctaatttgtacattgggctaaattctggatttttcttaatttttcttgcataaatcattaagaatataacacctacagctgttgttataacccataaaatagtacggtattgtaatcctgaaaataatggaatttcagctattgattgtgctatacctactgtaaatgggttaagcatagctgttgcaaaccctacgatacatcctaagtaacttacccctactgctaatatactatcaaatccaagtgctaacattaaaggaatcaaaattgttataaatggtatagcctcttcagtcataccaaaagttgctcctccaagagagaacaatgtaaatataataggaattattaataattcattacctttgaaaacactaacaaccttagcaatagctgaatctattgcttttgttctagttattaaactaaatgccccaccaacaacgaataagaatgctataatttctgctgattgctctaatccacttatcggtgcttgcattaccgaaaataatccttgtgcttcattttcaacatattggaatgaaccatttaatactacagttctactttgtccatttacttctgtaactactctttcatatgctccacctggaactatgtatgttgctattgccattaatattattattgaaaaaataataactaatgtatgtggaacttttattccaccactaaactttttccaaaacccttttctttcgttttctactacattttgcattagtttaaaatccccctgaatttattctatgacattctagttgaaggagataactttttaaaagctctatgctaataagtgatagttcttcacagtttaattaaaacaaaaaagtcttgagtttatcactcaagactatattactaacaaaaactaataaaatttaaatcttatcttttgtaaaaatataaccataatagtgatagctcctcacaaagcaaactgtgacagtgttatgtatcttctacataaccccaatgttatagcctcaaagcattaactatacatttcggcgaaatttcctttctgtttacatcactgtgcttacctccgtaaacatactcttaaatatcgcaacctctacctacttcatatctatttgtcatttataatatacatttttttatgcatattgtaaagtcaattttgtataaatataaatttttcctcttaattcttcaaaatactacattaataatatacttatattattactaaattaatttgcccttatctttgtttacatacaatttcaatacttatctacagcagcatttaacattaatttatatccataatgatatgtatgtgaatattcaaaagcttctccaccttccaatattcctatttgttctatgtgaagaataggtgattcacactctaattctaatagttccattaattcttcactagatattaatgcctcaactacacgttgcgctgtagatattttatatccacacttctccaaatatttatataatgaatcacaatccgttttctttaaattagggaacatctttacaggcatataagttatcatataggaaaccggagctccttcagcataccttactcttttaacttcccaaacattttcccctaagtctaaatttaatttatcttttatatttttatcagcttcaactatagataaactaattaatttagttattacactatatcccttattaatcatttccttagtatagctttgaatattactaatattatcagaaattctattagctaaaacaatgctacctatacctctttttcttgttatatagccttctttaaccaaattattgtaagcagatcttactgtcattcttgtaacattaaatttttcacataatttattttctgatggtaataattcaccttgttttatttcaccagaatcaattaattcttttaaatacttttctatcttaacatatattggctcacccattccttaaactcctttgtatactactacaaatataagatgtatgtataaataatcatattatatatactttattatatcatattcacatatttaaattttttcatatttctttatttataacaaattaacgatatagctttaagaagtattttcttaatccataccgttaaatgtgtaagatatataatataaaaatggtttgtttatttattttctagctttactaatctttcatatacttctataaattcttcagctagttgctgaaaattcatagcattcattaaatgatcttgtgcatgaattaataatacatttaactccacgctatttcctgaagcttcttcagtaataagcttagtttggaatgcatgagctttatgcatttcttctcttgatttatttattaactctcttgcttcttcaaattcaccagctttagctttacttaatgcatcatatgctaatcctttagcttctcctgcattagctataagaccaaatgatatttccattaattcttctttcattttcatatccccctaaatattactgtaattagtaagttctatattatttattcttaaatattcttttactttttctgatgttaaaatactatattctttcattctttgcattgcataagatgttgagttaactaaatactcatctataaatgctggatgacacataatatctatcacatcatgctttttaatttcatccatatatttttcaaagtaatcttctgttacattttcattataaaagctttcagtcattggtataacttcatcataatctagttgtgattcaaatccaccccttataggaagtttatactttttaactattttctctataacaggttttaaacttgataatgtatgaacatgatgatgcgaatctaagtgatcaaccttcactccactattgataactttatttatttggctacaaaattcttcatatacttcatctaaatcaaacttttcttcaacaagttcattagttattcttctataaaagttaccattttcatctactattgtcttatgataatttaaaacaggtctatttaagcttaaggtcatatgaaccccacaacctaaacctttattttcttttaataactcaacagcatgatcaaaagctggcatccctgccattatagtagttgaccttactattccatttttatatgctgatattattccataattaactgcttcacttaatccaaaatcatctgcatttactattaatttagtcatattaacacctcttctatttgaattgtggtaaatattctttgtgtgcttccatcatttcatctagaatagttttagctaaatcatctgatgggattaatggatttatacataatgcttgtaatgctgcattataatcaccttcaacagctgcttttgctgctaatatttcaaatgcttttatttcactaactaatccacttactgcaactggtaaatatcctactgataatggttttgggccttccttagttattacacagctcatttctgctgccgaatcttccctaaagtctcttattgcaccattgtttaatgtatttacaacttgaatatccttcttatcattgtaaattgaatttattaagttacaagctgcatcactatagtatgctccacctcttttttctaattgtggtggtttaacagctaagttttcatctttatataattcaaataagtcgtcttctagagctttaaccgtttctcctctagtttttccatccttaaagccttctaattcttcttctaacatttctttatgtttgtaatagtatttatggtatggacaaggaataactcctagtgctctaacaaaatcagcatttaaaggaatgtcctttatattttgcattgttaatgatgaagtaacaaacttttcaattgcttcttttgttatatctttaccatctaatcttacgtttaatgcatagaccatatgattaagtccagcaaagtccatttctattctatctttttcaacttttaatatgtctgccataccattttttacacctattggaacattacataatccaatgtatcttctaaagtttgtatatttaaatactgcttctgaaattactcctgttggatttgtaaagttaacaagccatgcatttgggcaaagttcttcgatatccttaattatatctaatactactggaactgttctaagtgctttaaataatccaccagctccattagtttcttgacctataactccatgtgaaagtggaattctttcatctttaattcttgcatctaataatccaactctcaattgagtagttacgaaatcagcatcctttagagcttctcttctatctaaagttagatgaacctccatgtctactcctgcttttttaaccattctttttgcaagattcccaactatctctaacttatgttttccttcttctatatcaactaaccataattccttaacaggtaattccttatgtctttttataaatccttcaactaattctggagtatagcttgatcctccacctattgtaactattttaataccatttttcatattatccaccatcctaacatttatatttataaacttgctttgattaatctgtatgtattgcattttattttaatagttcttatttcttataatcttatttaagatagcattttatatgctgatttttactcactttgtaaatgaatacaaaacaaaatataaaatgttttaatttttagttttggaataaagtcggcatttatgtcgactttattcctctattaaccataaactaatatatttatttttttatatcaattaagctacttgattcatttccatttttctagcatccatcttttctgccatagccacgaatggtaagtatattaagatcgaaactgctatattaactatacataaaactgctcctgaccaatgtcctgttgccataaatccaccaagtattggaggtgtagtccaaggcatagttgccattattattggatgaactaatccaaatgaaattgataaatatgatattattgttgtaacgattggtgctattacaaatggtattccaaatatagggtttaatactattggtaatccaaatattactggttcactaatattgaaaattgatggtgctaatcctaaagcaagcatatctcttcttctcttacctgcaattgctatagcaagtaacaatcctattatcactcctgatcctcccataaatacgaaagcatcaaagaatggtcctgctaatacatgtaattcatctaatggagctccattttgaatcatttctgcattttgtgctcctaagttagttaacattgttcctgtgaaaggtaatgcaatgtttgcaccatgtaaaccaacaaaccataacccatgaataaagaatgctattaatatagctgatggtaatgtatctgttatattacttaatggaattcctaagtatttgtttattaaatctgttaagaattggccatctgctgctaatcttattagtaatcctgcaactgcaaatataactactgttaacatacctggaattaattttgcaaatgatcttgatactgctggtggaaccccatcaggcatcttaactactaattgctttaatttacctaatctaatgaatacttctgttgataaaatccctattataattgctgtaaataatgctcctgttcctaagtatgcaactccaacaaatccccaaccttctactactggttgtccatcaattgcaatctttgcaacttgaggaattaaaagaataaatattgatgttgctatcattgctgattgaagaccattttcttcatatgatttagctaagttatatgcaacacctattactaaaagtaaagccataatagctaatgttccaaaccatatatctccgtttaatgattttatttgttgcccaaatgtattatctgctaaaaagttacttaatgcctttattggtgcgttatttataagtgttgctaacgaacctattattgttaacggtatcattgaaacgaaagcatctcttactgatactaaatgcctttgtgctcccatctttgctgcatatggcgttatatacttatccataaaagccataaacttttccatatcattcccctacctttatcttgatattttttaatttctcattaattatcaatatctatttctttaagtcttatcaatatcttatttctttaactctaatgctctttctaaaacagccttaccattacatcttccataatccatcatattaataacttctactggaattccaagtgggtctgctaaagcttttgccttacttaaaatgtatctaacttgtggtcctaataataaaacatcacacttttcaatttcactttgtagatttacttctgatattgcccagatttcacattctactcccttttcctttgcagcctcttgcatttttgttactaataaacttgttgacatacctgctgagcaagctaacataatttttatcataatatatacctccaaacatttatttaattcatgtattcgtttacttaccttatgtatacattgtatatccattgtatatacatttcaagtgtttttttaaatattttttattttttttatttttatgtttattatgtactactaatggctattttattaaaaatagccccttttcaatatcatttattcattctaacacatattattttccaccactgtcctaaaaatcttattatccaaatgtatagacatttgtttttcctatatacattttgtttttacttataaaaaagtctccaaagccaatccattcaccggatttaactttggagacattaatatttatttaaaattaattacctttaatctatgtagagctctagttgccataatgtattttactaaatcatctgtattatcatcaaaattaactattataactccatcaaattcaagtccttttgcataataagaaggaactataacttttccacctctataaataatatcttctctatcaaaagctaaaagcttagtaaactttttaagctctggtgctattttcttaaggtgttctttatctttagttataattgcaatattatcataattttcatcatcataatcttctaatgtttctaaaatagtgtcaattaaatcatctttatccttaacatcaacttcttcaacatcatacttaccttttctaacaaaaggaactattgcatcttcatttaataatttacttgcatactccatgatttggaatgtagatctataactcttatttaaagcatagttcttaacaaatccaccaaataaagcctttaatctaagcattgctggtgtttcttctactttaattaatctttgatttgcatctccaactatagtgtagcttctgcaacctgttaattcttttaatacaataaattggagcatactataatcttgtgcttcatcaattactatatgcttaatttcttgactaacctttttaccatcaagcttaatcattaaataaagtattgctggtaaatctaaatatgataagttttgtgttttagtgaattctttataaatatccacaatactttcattatctatccatttagctaaattatttttttgaatcataagttctctaacaatttctctaactcttatttttctttggaactctatattgttttgctcaattactaattgttcttctgaaagagattctagtttttcttttacttcatgatttaagcttcttactaattcatctctcttatctttaagctttgaagtaataattctctttatcttttgacttcttctaaataaaggcatgtatttataatgcttttcaaataactcattaatttcttctattgaaactacttcttcatcaaagaatttaactggttcaaaattaaagtaattagcttctaattcttcacactttttatctaaaacagctatgaagtcttctccacccttatactttatttcatttataatttcttcatttccatttaatacttcttctaaataagctgttatatcaattacgggttcatttaatccaatttcatttattgcaaagctagcaaatgtttgttgattaacattactttctcctaaagtaggaaggacatcccctatataatcaataaatatatcattaggtcctaatattaatactttatctcctaactgctctctgaaattatataaaagatatgcaactctatgaagcgctattgttgtttttcctgagcctgcaactccattaacaactacgaccttcattctttcttctcttataatttcatcttgctctttttggatagtcataactatatccttaagcttttctccagcatttgaagataaaatcatttgtaaaatatcatctttaacatctacatcagaatcaaagcaaccttcaagcttaccttttttaacaagtatttgtcttctacctaatatatcaactggaacttcgccctctggagatttataactagtctttcctaatgttcctttatagaataatgaagcaactggtgctctccagtcaactattgctgcatcaaaacttccttctggagttaatccatatcttccaacatagatttcttcagcatatccattatcctcaaaattaactttaccaaagtaaggagattcttttagctttgtaaattcagctaattttctatctatagttctatacatttcttctttgacatatctctcatggtcaaagtattccattactttatcttcatcgtctctatattcttcaataaatttctttctgtactctaatatgtagtctgcaacatcttttcttttttgtatgtaatttaatatttccttacttaataaattaagagtatattctaagttctgttcttcttgtaaaaattcaaatttattcaaagctccacgcacctttcagctaattactaattagtagttttgagtttatagtcctttatataattagtagttttgagtttgtagttaatagtttggattaaaattccttgagaagcttcttaagtatatattttcaaaattcagcctaactgaatttattcctaaactcataacttataactattaaaagtttctaactatttttaaaggcagttaaggagttaagctgtaaataatagcttaaccccttattaattatacttatttataatttgtcttttagtttattttctgagttttaatatacttttgaagccttatcctagtcttctttagtttcttcctcagaaactttttctttgtccatatctaatataacttcaacatcagaagacgattgttttattatatcttcttccttttcaacagcttcaataacttcttttgctactttagcatcttgtaattcttctgaaatctcttctgaaacttcagttgccttttccttgttattttcaagctctctacttttcttttcttcttctcttttttcctttaattctggatatttttcatatacaaacttaaagaattcatctccaaaaatagtttctttttctaataagtattcagaaatcttatctaataggtctctattttctcttaatatttctcttgccttttggtgacactgtctaattatagttaaaacttccttatctactaaagttgaagtttcttcactacaatttctaacagctctaccatctaagtatctgttttgaactgattctaaagccatcatatcaaagttatcagtcataccataaatagtaaccatatttcttgctgtttgagttgctctttcaatatcgtttgaagctcctgtagatacaagattaaatacttcttcttctgcagctctaccaccaagcataaccattatttgattcattaattcttctttagaaacaaggtatttttcctcttctggaagttgcatagtatatcctaatgcacccattgttctaggaactattgtaattttatgaactggatctgtaccttctaaaagtccagcaactaatgcatgccctacttcatggaaagcaacaacttctctttctttcttagaaagaattctatctttcttttctttaccagcaattataacttcaactgcttcttctaaatcttcttgaataactgtttctcttccacttctaactgctcttaaagctgcttcatttactatattagcaagatctgcacctacagcacctggagttccctttgcaactgattctaagttaacttctggtgacattttaacatctttagagtgaacatttaatattgcaattcttccttttaagtcaggtctatcaacaataactcttctatcaaatctacctggtcttaaaagtgccttatctaatatttcaggtctattagttgcacctaaaataactattccttttgatgtatcaaatccatccatttcagtaagtaattgatttaaagtttgctctctttcatcattactttgcatttgattatctctactcttacctatagaatcaatttcatctataaatattatacaaggagccattttttctgcttctttaaataagtctcttacctttgctgcacccataccaacaaacatttcaacgaaagttgaacctgaaactgaaaggaatggaacctttgcttcaccagcaacagcttttgctataagagttttacctgtccctggaggccccactaaaagagcacccttaggtaatttagcacctatttctgtatatctcttcgggttatgaaggaaatctattatttctgttaatgattccttagcttcatcttgccctgcaacatcttcaaaacttacttttatatctttttcaacatatactttggcattgcttttacccatgccacccatgcccattggacctccgcccatttttttagccattttattaaatacaaatctaactacgaagaacattattactaatggaagtacatttaatataataaagtccatccatacagattgttgctttgttatttgaggataatattgtacatcattatctattaataattgtattaaatctggattatccgcatttcctgtataaagaactttccctttcatatcacttgaatcttgaggtgttattacaagtgccgtcccatctacagtaacttctttaacttccttatctttaaccatttgaacaaattcattatatgaaatttcctttgtagttaacatctccttagctgttgaaaatgaatataaaaacaagaaagctactacaacataaattaataagaacttattattgttattcttcttcttttctccattttttctattgtttaaattattattcatactttctttatttctcctatttaactcttaatctctttttaaagctcttattctatttttccaaaatctttccatggatatacttttatctgagctttaccttttatttcactagcatcaatatatggatcattccaatacctagaatctaaagaccaatatctattatctcctaaaaagaaatacttaccttctggcacttcaaattcacccgtataattatctgcggttcctatataattttctttaagcgtttcgccatttacacttacaactccatcttttataacaaccttatctcctggtaatcctattagtcttttaatcatatcttcatttttttcttctgaatgaaaaactactatatctccacgtttgagtttctctggattgtaaactctgctaacaaataatctgtctccaacatttaatgtcggaaccatagattctgatggaattttaactttaaaaattagaaacctattaattaaaaatgctaatattactgctactactattggtacaatccaatcattaaaaaagtttgttttttttagttcttggctcactctttccacatacctttcattaaagcatttatattgctttttcgcttcttagttgcttcttcatttactttaaatgaagtatcatcaatcttaattattacatcgccttcactaggtctagtatcaaacaaatttatatctattaagattataccctgtttttcatcttctaaaacaacagaattttcttctattctgtctactataaatttctttttctccatactaacactctctatttattcccctttgcttaagatgtaaagttaataacaagtaagtatattatatactttaatttttttctattgaaacttaccataatttcaataactgcctataagtataccacatttcattaataactaatagtattactctccattatatatctttattatgtcaattttgttacaaaaggtttaatgttgtattaaattattaactattaatacctttcaaatatttataatgctgattcaaaatatttatatgctcaaatatagtaagaatttttaatttataaaataaaaggtataataattagtaagattagtacttaagagagttaaagtgacaatcttttcaagtgacaagtttgaagttatcaaataaactcagcttagtctgaatttaaaaataaaataacctgaatcaacatagctaattcaggttatcattaaaagaaactccagaaagaacttccacatcaactattaactttcataaaattctcacttgttacttgctaaacttcaagctctaaaagttcctcataactttgtcttttagatacaagtcttgcaacaccatctttaataaataccactggtgctttaggatttttattataattgctagacattgaaaatccatatgctcctgttgaaaatacagctaatatatctcctatctctggcttttgtatacaaatatcttcaataaatatatctcctgactcacagcatttccccgctattgcaactctagtattaactttttcatcaattttattagctatagccatttcatacttagctccatataatgcaggtcttatattatcagtcattcctccatctacagaaacataagtcctaacaccttcaatatttttaattgcaccaattgtataaagtgttgtacctgaatttccaacgattgaccttcctggttctatagttaatattggtctttccatatttaattttgaacaaacttcatcaactttatttaatattacctcacagtactcctttggttctcttggtttatcttcatcagtataatgtataccgaatccaccacctaaatctaattcaggtattgtatgtcctgtttggtccttaatttctttcataaaattcatcattacttcaacagcatctttataaggttctgtttcgaaaatttgagatcctatatggcaatgtaaaccccttaaatttagattttcacaatctaaagcaatttttactgcattcataatagtttctccaacaggtgcaaatccaaactttgaatctatttgtcctgttttgatataatcatgtgtgtgagcttctattcctggtgttaatcttaaataaatatcttgttttacattgttttttccagcttcttcatttagcattttcatttcatctaaattatctaccacgaatcttccaacgccaagtttaacccctaattcaatttcacctttgcttttgttatttccatgaaaatatactttatttaaagggaatccagccttatatgctgtaaataattctcctcctgatactacatctaaataaagaccctgctcatttacaagcttacacattgcctttgttaaaaaagcctttcctgcgtaggcaactctattattattttctttacacttaaaattatcataataacttttacatgtgctaattaataaattttcatccattacgtatagtggtgatccaaattctttaactaaatcactacaactaatcccccctatacacaattcattacttttaatttccattgccccaaataatttcattgttatacctccaaaatattattaattaggagttagatagtatagacgtcattaataggttattcactaaaactacttttgttatccatattcacaaactaccaatttataaaaaataataataaaaactacccctatagaaaacctattgaggtagtttacttattaaaatgcaatttttattcaaaaaataagttcaatcatacaattgaataattgcacctttttagcactccactttcgtgacagttatacatatattatatgcatacccagaaataactttttacataagatatcccttcggccatcatacctttcataaattatcttagcccgtcagctccaatttactactctttataaacagcacctctaacataggtattctattaaattttaacacttaaattttctcttaataattaaactcacttttctctcttattctgaaaagtttcgttcatatatcatatgtacatcgttattaatatgataccatattaatttaattattcaaccatattttattttttattccattttaactatttgcttctatatttatccataagattactcatagtatcaccatttgatggaggtgtataagttatcgcattggctcctgcttctattgtttttcttattgtctcttcgtttggtcctcctgtagctataacaggaaaatctgggaactcgtcctttatctttttaactatctctggagtgttttttccacccgaaacatttaatatagttgcacctgcttctattctttctcttatattctcatgaatagatacaacagttactattaatggtatatctatagtttctttaattcttgaaacaacctcatttgatgtaggtgagttaacaactactcccattgcccctttaaactcagcatctaatgctaaattaacaactcttttaccttgagttattcctcctccaactccacaaaaaactggaacatccgcagccattactaaagctgatgttattaacggttgaggagtaaatggatatacagctataatagcatctgcatttgtattcctaataattgcaacatcagttgtaaataataaagattttattcttttaccaaatatttttatccctgaacaatctcttatacatgaaggcacttcaataacatgacttcttaatataccttttatctcaggtacagttttatgctttttaatctccatcttaacactcctattactaattttataaatataattatactagtttaattcaagatttaaagaactttaaaagaactttaaaagaaattgaatcaaaagttaacactttatataaaaaacaaaaaaattgataaaatattaataaatatgcaatatagagttttatattagaagtaacttcttctcctaacgtcaaatgcttacattgtatttaatttctatttcacataatattgttatgaaaaacattaaatacaaaaacaatagtgtatgattcattaattattaatatatcctaattaatatgccctaaataaaccaattaatttacctaaaatgacgcagtcttcaacttatacacatcccatttttttaaagaaactcctcaaaagtttaatccttaacttgtcacttacttcccttgtctcttactaaagtattatttgaactggttcatttatctcaattccatcttcagtaactatgcaattatatgcaaaaatatctacaccattttcttttgcgaatctaagcgccttaccaaactcttcatccctttcatcatttggtgagaacttatcaacatcttttaattgaattaaaaacattgctccagcgccatatccttgctttttagcttctactaattctaataaatgctttgcccctctttctgttggagcatctggaaatcttgcatatcctttatcttctaaagttactccctttacttctaaaaaatattctttcccttgctcatttgaaattttaaaatcaaacctactttttccaaatgttttttcccttaaaattttagtatattgactaagttcttttaccttaccattttttaatgcttcttcaaccactttatttggtatttgtgaatctatacttattaatttatcttccttatatactgccattaaatcatagggggtcttcctagtgggatttgattcttctcttaagaaaacgttgcatcctggtataagaagttctctacatcttcctgtattcggtacatgtacagtaagttcctctccatttaatctaactattgcattaaacctatttggtctacttataaattctgctgttactatttttttattatatttcatgttttctcctcaaattctcacaaattatgtcttttttctgttattatttaagatttattatatctcttaataatagttatccacaacctataattatatattcatttgtttttatacgaataattacttaaatatcgagttatccacagtttttgtccacaaatctgttgatattgttgataactttttaaaagaatgcttgttcgattttttttattctacaaactgcttgttttttttacattaccccctatatagttatttatttttgtagtaccctaatatattgtgtcaatacttcagaaaaagttttcaacaaattttaatacttatccacattttgtggataactttttttcttatatactattcgtaatctacatattaatcatttttaacatatcaattgtttatatacgtataaaataagctgtagattgcattaaaatatctctacataatacaatctacagctttaattgaattaaatcattttcttttccttaaataatgtagctaaatattgaataataaatattgctggtcctaaaattatagtaattattggccaaataatatgactttgagatttttctttagctaacttatatgaacaatataccgcagctattaataatgcatatgaaaatatgtatgacattctgccttccccctactgtttaataattattattttacaaaaaaaatatctaaccctcaatgtatttttctataaaaatattaaatatcctaaaaatacaaatcctaattgcttagtatccgctgttgcattttattcttttattatttatatttattgtctaatacaactttttattttttttaaaattttttctaaaaaaattctttacagtcgtttttcactatgatattattactaatgtaatcgaataacgagcgtgttactggtaatgcaggcaaggcttaagtatgtataaattattattttatctcaaataatacttatgggataattatataatttgtagatatttgggcctttttttattgtctgattacagcattacattaagtcccatgctattatatttaacttattaataaaaaactatagattttaggaggaataataaaatgatgcaatttctacaaagaattggtaaagctataatgcttccaattgcagctcttccaattgcaggtatcttacttggtataggtggtgctttcttaggtatagcaactttacaagatgctcctgcaatatacaaaggattaattgcttttgttaatattccagcagttactgctatattaacagttatgcaagatataggtaacattgtttttggtaacttaccaatattatttgctgttggtgttgctgttggtttagctaaaaaagataaaggtactgctgctttagctgctgtatttggtttcttagtaatgaaccaagttatatctacacttttagctttaggtgttactcaattaggtgttgttactgctgattcagttggtaactatggtacttatgttactactaatgttggtatattcacattaaacatgtcagtattcggtggtgtaattactggtttagttactgctttattacacaataaattccatacaattcaattaccagctattataggattcttctcaggatcaagattcgttcctatagttactgctgttactatggcatttgttggtgcaatattagcattcgtttggccagttgttcaagatggtatcagtgtattatctacattagttaaaaatgctggtgtaatcggaacattcttctatggattaatagaaagagctttaataccatttggattacatcacgtgttctatactccattctggtatagttcattagttgaaggtaacgttctagttaacggatcaatccaaactgttgctggtgcaaatacagcatacttcgtacaattatcaagtatgtcaagcttagttggtgcttctgcttcaacaatgagtgaggttataagtggaacaactagattcatggctggtaaattcccattcatgatgttcggtcttcctggtgctgcacttgctatgtacaaagctgctaagccaaacaaaaagaaaattgttggttcattattagctacagctgctttaacatcattcttaactggtattactgaaccattagaatttacattcttattcgttgctccagcattatatgttgtacactgtgtattcgctggattatcattcatgttaatggatttactaaacgtatttataggtatgacattctctggtggtgtaattgactactcattatttggtttacttccagctggtgctggtgttccaactaattggtactgggtacttgttgttggtgttgtatatgctgtactttactacttcgtattctacttcttaattactaagttaaacttaaaaactccaggtagagaagatgataacgaagaaactaaattattcacaaaagctgattaccaaaaagaaaaaggtaatggtgctgctgctgctcctgcaaaaacttctgctaaaggtgaaatagctgaaaaagctcctctagtattagaagctttaggtggagaagcaaacatagtatctgttgatgcttgtattacaagattaagagttgaagttaaagataaagcaaatgttgataaggatcaattaaaatctcttggagctgctggtgttgttgaagttggaaacggaattcaagcaatattcggtgcaaaagctgatgcttataaaaatgctattaacgaaattctaggagaataatattaaatatcaataatttaagtgtgttttaaaatattcggattaaaaaaagtggcgaaagccacttttttttatttataaatataatctctagtcattggcaattcgttgttaacaccttttacaaataatatttggtgtaaatctattattccattattaaatacagctgcacatgcatataagtacattctccacattctaataaattcatcatcaaacatcgtcttaattttatctatattatcatcaaagtttttagcccacattaataatgtctttttataatgtaatcttaaactttcaacatctattgtatggtatttataatcacctgatatatttataatttctctaaaactcggtagaactccacccgggaatatatactttttaatccatgcatctccctctgactcttgaataccacttatataatgtaataggaacacgccgcctttctttaatacagaatctacatttttaaagaataaatcataattaggtcttccaacatgctctaacattcccacactaactactctatcaaatgaaagattactttttgataactctctataatccattatctttacatctatataatcttgaagattttccttctctattctttctttaaatgccttgtattgttcttcacttaaagtaattcccaatccttttatcttataaagtttagctgcttcaattaataatccgccccagccacaacctatatcaagtaatgataatccttctgataagtttaacttctttaatatatgatggattttgttcatttgagcatcatgtaaagtatcatcgcatttattaaaatacgcacaagaatagcttaatgtatcatctaaccatatcttataaaaatcatttcctatatcgtaatgagatgtaacttcttctttttgttttttcatagaagttgatccaccaaatatctttgttaatgctccaaagttagttgaaaattcatctatacatttaagtaattcatcaaatacagtaaataagtccccttctacttctatatcgcccttcatgtaggcttcaccaaatgctaatgtagtgcttgttaatatatccttcttttttaatggtttatgaagtataatcttaaactttggattatcttcgcctactttaacttcatctccatcccaaaattctacattgaaagaaacacctttaaatttacctaaaaatgtttttaaaaaacttttttctaaatccataagtaactcctattctatttattctatttattttatttaatatagataagaccttgctgttaatacttttttattagggcgctattgataataaaaaaactattaacagcaaagaatttgaatctaaaaccgactcatatttaaattattccaaaacagataaattttattcaaaaagttaagcagtaagttgacttactgcttgtttaaactaatttttaattagacattcatcattttctttttttctttctcttccttattcttttgtttcttttccatattttcttcccataatggttctgctctcttagcccatgttaatccataatctatagtctttttacataaatcatctacattttctggatctataaattcagtagatttagcacctgaatttttaaccatctctgctatcttaggtgcattatctaatattggacatggtctaaattgattttggttgaaaggttgatttttttgatattccataaataatggttgacctaaagcttcaattaaagatacatcttttatatttgcatttgaataatggcagaatacacaaggctctacatcaccatttgcatttatatgacagtatcttcttccacctgcaacacatcctccaacatattctgcatcatgccaaaaatccatattgaatatagctttagtattacgccaaccccttatagttctatataacttttctctttgatctggatttgccattaatgatgtatctgttttacatcctattggcataaatgtgaaataccaagagaaatatgctcctttatctatcattaaatcaataaattcttctgaaaggacactatcgcaatttgctgttgtaaaacaagttgagaatccaaatggaattctattagctttcataagatccatggctctcattatatccttccaagatccatctcctcttcttccatctgtagcatcatcaaatccttcaacactaattgtcggtactaagttaccaacttcaattaaatcatcacagaatttttgatctattaatgtaccatttgtaaagaacataaatacacaatcattatgttttttagcaagctttaatatatcattctttcttactaatggctctcctccagtcattatatagaagtatatacctagctctttaccttctgtaaataacttgtctagttgttcatagcttaaatttaaagccttattataatccgctgcccaacatcctatacaatgtttattgcaagctgtagttggatctactaatattgtaaatggtatttcatgaccatacttatctttatttctttgtatttcagcccaacctctaatagctgcatttaataggaaattagtaaatactgtttgaactatgtttggatttacattattgattatgttacacattagtttagtccagttattttctggatcctttaaatatccttcaatcatgtcatattgctcaacatatattttttctgtatcaaatcttctaatccattccattattttaggtaaattcttttctggatctttctttaaataccctaaaacttgttttaatgcaaattgttgaattttatattttggacttaacatttaaatatctctccccttcaaataatattaaaataattacatataatttttataccaatagctaaaagaataattcccccacaaatatctatttgttttttatatttgttacccatacagtatccaacccataacccaatagcaactaatatgcttgttactataaataaaattaatatattacttataatttctgttcttaataagccaaatcctattcctaaaataaatgcatctatacttgtagctagtgccaatcctacactgcctttatacccaaaaaactcctctctcctttcattatatttattatccttaaatgcatttcgaaaaaattttatacctaaataaaataatataatcgctgaaaaccattgatttattgatataattttttcattatttatatttaacatagggtataatgcaataatcattccagccgccaacataattgtttgaattactccaaatattatcccaactaatattgctgttgatttttttaaattaccctgtgtagatcccttacatactgctatagtaaatgcatctaatgatagtcctacagaaactataatgacttcccataatcccattcatctaattccctcctcatatttcttattttagacttatcatccaaataaaggaatctataatatcgctcatttgtatttataaataaacaataataataatttgtaatttttgatatacaaacattacaaaatgtatattaaaaaagcatattaaaaattaatagaccactcagtgcattaactatacctgagcggtccatctcttaaaattacattattcatttaaatcattgactatatcatctaatgaatttgttactaatactttatacttattagataattcctttgctgaaatacttattccctcttctatccatcttttaattataaatgttaaccctcgtgaatagtattctgcaatatcatctaccggaaatttttcatttttttcattattggttccatattgctcaaacaactttttaaacattttaactaaattattattaataatttcttcaaaagaattttgtcctgttactttaactgcttgtaagtaaaagctcttattattttctattcttgaaaacatataatgtatagcttcataaggcattttgctttctattaacatttcgcttcctttaaatatatcctcatagcaaatttcctctaaaacttcatacttatctgcataatgattataaaatgttggtcttataaatcccgcaccatcagttatcatcttaatggttatcttatcaaaattatgcttcagtattaaatttttaaaactctcttgcaatgctgtatgcacatcttttctattattcataattcacctacaaactgccttatatttaaagtaaataacttcatttcacaaatttgaaatcataattttctaattaaagataagattatacagattgaattataccatattttgtaatattatactatctatttaacctgtttctatctttattatataaactactataataatataaaaaaactcctaatattattactatttattaatattgattatccttatcttttataaatataaaaatgaacataatattactactatgttcatttttatatttgctatatatttttttattttctttttacaatcatatattttttatcagcttctatacatatatcaattaaagaagttttatcaccaatatatctattaaaatatctacattaacaattcattccttgataagctcaatcattacttctattccttgcctattaaaatatctacattaacaattcatcccctatatgatgccctaaattatcattaacatatttaagattatttaaatcaagtgaaattattatattatttcaagcattggattgctattttttttatatctggtaagcattcatcaaaaaacatcttatatgcttcacagaaataattaatcccttcttcctcacaaaactgttctctatgtctgcgacatccacctctacaaatcctaaaataatcacatcttttacatctttctgcatgattataagattgctcaacaaactttattattccccgtttataattaatgtcatcaaaatcattaatgaggaaatttcctaatttatacgaatccaaggcataaaaatcacaagggtacacactaccatcagcctccactatagtttggaaactacaacttcctctctgttcacatgattctatttgggccccaataagaattcctatataattttcaaactgtcttatatatggttgagtaccttgatacaagtcccttttccacaacttaaacaactctatcaaaaacttaccgtatacttttggtgtaagcgaatattctttttttactttatttactcctattggatctaagcaagcaatatactgttgccatataaatccttgctttttataaaattcataaatcttgtgaatttcttgagctgtactgctgttaactactgttaaaatattaaattctatatttgcatttttaagcaaattagctgcattcattgcattttcaaaagttcctagtccagaataatccttcctatataaatcatgtgttgatttaattccatcaatagataatcctacaagaaacttatttttagataaaaagtcacaccactccttgttcaataaatacccattcgtctgaatggaatgactgatttctatattatttacattatagcgcttctcgtattctaaccatttttcaaagaaagaaattcccgctaatgttggttctcctccttgaaataaatatttacaatggccagttgcaaaagataatgttttttgtactaccttatcaattacttcatcatccataattttcaagcatggagattctctattttgtatttcatctgaataaaaacaataatcacaccttatgttacataatcctgatgctggcttaatcataaccgtaatattgggcatctttctctccttccgctttttctattttttattaattaattattctaaaattcaattataaaacttatacataataatttagatcacaaaacttacacttaactaaattagtacaaataaattttcaatatatcaccattagcatacttgtcgctttaaaattaataaaggatgatgaataaatataggtctttgtcataatacaattgttcaaatatattaaaactacacctaaatatttgatcttaaacgttcattttctttctcaacatctaatttcatcagcataattgcaataataatattgatacccataggtatccaaagatacataatataaagcatattaatacatgattgactttgaactgctaaagaaccatcaaatccactatatgcaagtaaccatcctgcaatggcagttccaattccgcctccaattttcaatccgaaagaagtacaagaatacatagagccatctattctcttatgtgttttcagatatgtatactctgaacattgtacaataagtgaatttaaacctccctgaaaagcactcataccaaaggcagcaactcccgtaaataataacatcaatggtaagctgccaatatatcctgctactacaacaagtatacgcccaatagccgcaattatatatcccgttgcatttaccttgtactgccccttcatttttgctacaatcataggcgtaattgataaaccaatgataataggaatattaattgcccaagagaatacaccaaataatttttcacttcccaaaacatatgtcatatagtaaatacccatattaatcattgcattatagatttgtcgtaatatatcaacaactaaaataataatataatatttatttgagactaataatttaacaatttcgataaaactataatgttcttctgacttttgaagagttgtatcgtaaagttcttcagcaggtaattcttttactgaaaaaacagaaattgtgtttacaattaatccaacaattgcataaataatggcaactgttctccatccaatggcacctccgccaaatacctctaccatactaactgtaatcgtttgaattataaggcttgtagcaaatgcaaatataaatcttatagagcccatttctactctttctttactatttctagttataaaagctgtcaacgtagaatatgcaatattatttgccgtataaaatactgcatgcaataggatatatgaaataaagaaccaagcatattttgcaaactctcctaattcaactggaattgcaaaaagagcaactaacataattgcgcatccaataaatgcgcctaacatccacggccttgcttttccaaacttagtgtttgtcctatcaatcataactccaaaaaataaatcagttattccatcaaatagttttgaaacagcaattaaactaccaataataccagcatttaacccaatactattagtcagataaatcataacaaaagatgatacaaaagcaaaaactaaatttcctgcaatgtctcctgaaccatatccaaccttattgtaccattttaaatatcttttctcgctcattttctcttcccctctcacttttctcttcacccttaattcttttgtcttactgcactcttcattggtaatcctgtatcataatctaattgtctaggctcatactcttcattttcacgttgtctagtataaccttcattatcccacataggagttatattttttctccaaggtcgcatcaaccattgatatcccctatacaaatcacgtgtttcattcatatgattaattagaatatcatgtaattcatttcgttccttctcatatgattcatccatgattaagttatttatttcataaggatcattatccaaatcatagaattcatccgtatctaataaatgaattactaatttatattttttgctaatcgcagctctcattatctgtaagccaccaaatccgtcatgatctacctcataacgagtaaattctgtaaaaacaacatcatttattttttcagatggattatagatttgcttcaacatactctttccttcaagtaactttggaataggtagtccaaagtaatccattattgtaggtgctatatcaatgtgagaagctgcctcctcgcatacgcatccctttacccctccctttataatcaaaggaatattggcaacttctttgtaagctgtagcattttttgaaaataacctatgcgctcccagcatatctccatgatcagaagtaaatataactaaagcatttggtagaatttgattaatgacctctagaactcgcccaatttcataatctacaaaagaattagaacctaaaaataaagataatcccttagaaggcttattaatttcctcctcggttgcattgagattatttccagcccatacttgctgcatgaaaggttttttagataaatcatcttgaaaacttggacaactatcaaatttgaatccatcatacattgtattgtatggtgctggacataaagatggaccatgtggctcatcataagaaacagttaggaaaaaatcttgatccttaaattcattcaaaaatttaattgctctatctgaacatttatgagcatatgtaaaatcctcagaaaatccttcttcataagctgtttctggatttctagattttactcttttttcttctgtcaattcctccaaatagcatttcatatcataccaataatcttgattccacccttccgggcaaactcccaaaccaaaataatcaccaccatctaaatgccatttaccaatataaccacaattgattccattgtctgtaagtctctcaccaattgtctttacattagcacccattgcaatgctattagctaccatcccattcgtatgtggaaatgttccagtaaaaattgcacttctcgctggcccacatactggttgacatgaatatgcattttcatatcttatgccttcatatgctaacttatctaaatatggagtattcatgtctgaatttccatagcaccctatcatatcttttcttgttgtgtcagtcataaaaaaaactacttgtcttttcaaatttatttctcctttcataatttaacaattttcataatttaacaatacatattttcttttttttataaccttattataattaagacacatagaggaatcctatataagaaattgttttcattatggatgattctgcttttctatgttatggtattttaataaaaggaggagaattatatgattaatatttccgggcatttaagaaatcaacgaagaatcattggatacaatgatgatactactgcgttaatggtaaactgttgtggtgaacaaatttttaaaactaaagattattatcagaatcgatctaatggtaggctagactatcagatcatatatgtatacaaaggatcagggcattatttattagataatgaatggaagtcattatcccatggtaatattatcctatttaaaccactagaacctcaagtatattcctactatgctaaagagcacccagaaatatactggattcattttactgggagggaatgtgaatctcttattaacaaatttgaaattaaaaattgttatataggtgaaaatttactgttaaagcatctatttcaaacaattattacagagcttcagcttaaaaaaactcattatgaagatatcgtagtaagtaatttatattctatatttgctatgatttctaggttgtttcactcaccccttttaactactgaaaatgatttttcaatagatagacttataattcaacttaatcaaaaatatatggagccatggactatttcatcaatgtctgactattgtaaattaagtgaggggtatttcgcacataaattcaaaaaacaaattggtatttctcctatgaattatttaaatgaacttcgaattgaaaaatctaaggaacttcttgaagaaggaaccatgaatatttcaactatatcctctatagtaggttttcaagattcgctgtatttcagtaaagtttttaaaaagttaacaggtataccaccaagtaaatttaaaaaatacctcttagaatcacgtacacctgaatggtattctgttacataattacttaaaaaagcagaattatacatataagaatcattaaaggctatagcttaaaaactttacattgctatactcataagtagattttaattaataaaaatagaaagtgaggtagcaaaaatggtatatcttatcattatttgtgtatgtacgctgtcatcaatcattggttcgatatgtggaattggcggcggagttataataaagcctgtactagatgctgttggaataatgcctgtcaaaacagcttcctttttatcaggttgtacagttttatctatgtcaatagtttcattaagtaaaaatattaaaagcaataataattttacttttaacaaattgtttgcaactattttagcattaggtagtgttattggtgggctaataggtaagtcattatttcaaaatatattaaaaatatttcctgatagtgataaaatcggagcaattcaggcaggtattttattaataattacattaggaacattaatatacacaatttataaatataagattcatacccataatattaaaaacaagctaatagtatttcttattgggctaatcttaggtattatgtcttctttccttggaattggaggcggaccaattaatttgatagtactattctattttttttcaatgactactagtgaagccacaatgtattccatatatgttattatgctttctcaaatatctagtctcgcatcagcaataataactcgtaatattccctattttgatatcactattttgttactaatgatatcctgtggagtattaggtggatttattggtaatgtgttgagcagaaaaattaataataaaaatgtagataaattatttattatcgcaattctattaataatatgcattaatatttataatatttttagatatatttaaatcaggggcacctatttgactggttcccctgattattacttattttcatataattaattacttaattttaattcgatatttatcctattacttataacatagcaaagctacattctcagcagtaggctgtttcaaatcacttacttcgatcgctctttgacatcctgtgcatggaacgtgctagatacttctcttcgtcactatcgttccttgacaagtaaagctacattctcagcagtgggctgtttcaaatcacttacttcgatcgttctttgacatcctatgcatggaacgtactagatacttctcttcgtcactatctttccttgacaagtaaagctacgttctcagcagtaggatgaacaaatcgttccttttagtcactctttgacatcccttgcatggaacgtgctagatacttctcttcatcactatcgttctttgacaagtaaagctacgttctcaatatgagatgtatgtgggaacatatctactggttgaacacttgtagtcttatatccattttcctctaatatagctaaatctctcgctaaagtacttggatcacaacttacatatactattctttctgcatttatatgagttatagcacttaataacttaacgtcacatccctttctaggaggatctacaactaccacatcagcttttattcccctatcaattaaatctggtataacaacttctgattcaccaacaaagaattcaacattatcaacattattttcttttgcatttatattagcattttcaatagcttgcggaataatttctactccataaactttcttagccttttgtgataggaataaagtaattgttcctgttccacaatatgcatcaaatacagtttcatctccacttaattgtgcatattcaagtgccttaccatataaaacctctgtttgaataggatttacttggaagaatgataatggtgaaatattaaatttaaacttacctatatagtcacttatagtaggctcaccccacaatgttatacactcttgacctaatattacatttgttggtttagagttaatattttgaactatacttttaattccaggtatattatcaaccattaattttataaattcatctttgtttggcaacttagctccatttgtaactaatacaaccattacttcattagttgtaaatccacgtctaatcattatatgtctaagtattccgctttcatcatacttgccatcaacattatatggttttatgtcattctttttaatccattctctagtcaatttaactactttatcagcaacttcatcttgaattaaacatgtttccatatctattatttcatgacttcttggtgcaaagaatcctatttttaattctccattaactattccaataggtaattgaactttatttctatatctccaaggctcttccattcctaatgggaactttactatactttcatctaattttcctattttagttatacaatccttcactctttcaaacttaaagtttaactgttctttatatgtagaatgttgaagtttacaaccaccacatcttttatgtaaatcacactttgcctcacatctttctggagatgcttcaattatgtcaattaattttccaaacgcaaattttttattaacttttactattcttactttaactttttcaccctttaatgcaccttcaataaatattggaaaagtaccctctacctttgctattccttcaccttcatacccttgagcaattatatttaatatatattctttatttttctctatcaaatttatcacctatcaatcttatattttatcatgttagttaacattggctacaaatttatttatatattgtaatatctcatatcattatatactatacttattaattattctatctacaacttagatctataaattgactcaaaatgctaacttctgtttttgagcaaaaaaagagcacctttcggtgctaaataaggaatcagttgccacactgtaccattttaatctctctacgaaatttcatgatattaacattatagcctaaaatcctaatcttatttgtgaacattttgttaactttttatttttttgctttttttgatggtttttcttgcagtttttagatctattttgcttttcattgaattattttattcattttttcttcatgatatagtttaaataataaaatatcttttcataacctctataaaaaaaataagaagtgtaaatttacacttcttattttatgttaaattattctactacgcttacttttaaaagattagttgatccaactttatctaatccagcagctattacaactgtgtctccagcattagcaaatccattttcaacagctatcttagtagcattagccatcatagcatctgttgaattttggtcttcagcaactactgggtaaactccaaagcagaatgctaagctcttagcaactttttcacttggagttacagctacgattgggcattctggtctgcattgagaaattcttcttgcagttgatccactcttagttgaagaaactattgcagcagcatttaattcgttagcagcattacaagcagctcttgaaataactcctgatacagctggaatatgagccttagctcttgaaacagctgtttcatagtttaatttactttcagcttcaacagctattttagccattgtttgaactgattctactggccaatctccattagctgattctccagataacatgattgcatctgttccatcaaatatagcattagctacgtcagaaacttctgctcttgttggtcttgggtttctcatcatagaatctaacatttgagttgcagttacaactggctttccagcatcgttacatttttcgatcatcatcttttgaacagctggtaacttttcaaatggaatttcaactcctaaatctcctctagcaaccattaatccgtcagaaactgctaatattgaatctatgttatcaacaccttcttggttttcgatcttagagatgatttggatgtgttctccaccattttcgtttaatatttgtctgattgtttcaacgtctgaagcttttcttatgaatgaagcagctacagcatttactcctatttcacaaccgaattttaaatcagctatatctttttcagttaaagctggtaatttgattgaaactccaggaacgttaactcctttgtgagttgcaacgaatccagtgttttgtactgtacagtgaattttgtttccttcgattgattcaactgttaatcctactaaaccgtcatcgataaggatagtatctcctggtttaacgtcattagctaacccagcatatgttactgaacactcttcagtgttaccaataacatctccacctgcatgtacagtgaatttagctcctgcttgtaattcaactttcttaggatcaaatttaccagttcttatttctggtccttttgtatctaacataacagcgatttctttgttgtacttcttagctaattccttaactaagttaattcttgctgcatgttcttcgtgatctccgtgagagaagttatgtcttgaaacgttcattcctgcttcgattatttgtgataatatttctggcttttcactagctggaccgatagtgcaaatcattttagtctttctcatttaaaactctccttctaatatctaatttaatgtattttaaaataaaatattggcaatattaattaaattatttagaaatttcttctgaaatctcatataacttttcatcaaatgttctgtctaatgctagagcttcatctatatcttggtcaaagatttgattattctttataccaacaacttttgaagttttaccttccattaaaagttcaattgcttttgaacccattcttgaagctaatactctatcaaaagcacttggagctccacctctttggatgtgtcctaatacagttgctcttgtttcaattccagtttgagcttcaatatatttagctaattcagaagctccaccaacaccttcagcaagtaatactaaattatgcatttttccagctttcttaccttctaagataactttgcataattcatctttatcatatcctttttctggtgtaatgatgtattcagctccacaagctacacctgtgtgaagagcaatatctccacaatttctacccataacttctacgatagaaactctttcgtgagaagttgatgtatctcttattttatctatagcttcaactacagtatttaacgctgtatcaaatcctattgtataatcagtgtaaattaagtcattatcgattgtaccaggtaaaccaatagttttaactcctaattttgataataatttagcaccagtgaaagatccatctccaccaataactactaaagcttctacaccattatcagcaagaatttttaccgcttcttttcttacttcttcttgtttgaattctacacatctagcagttcttaaaatagtaccgcctctttgaattatatctgaaacagatgatctattcattgggaataactcaccatttattaatccagcataccctctttgtactcccataacttcaataccattatgtattgcagttcttactactgctcttatcgcagcattcattcctggagcatctccaccacttgttaaaacagctatttttttcataaaatattcctcctcgaaactactaaggactctgcatgtccacacactttgaaatattccttattattcttttattgttaaactttttaccaccttttttattttacttgtaatctcttcttattgcaactaaaataaatattcttatgtctaattttatcgtttatttacattattacctgtttattttgcccttaatcaattaaaattatataaatattttttatttttgtagctttacacatatttcaatattatcactttttttattatttttcattataaaatagaaatttacaccaaactttgttatataattaacatacttttaacgctaattatggatatttttggtttaaatttgtaatgaaaaactttaatttttattattcttttgtgaaatgttccaaattttaaaaaaaaatattatcttgctcaagaatttttccacaagataatatttttttaacaattttattctacaactttaacatttgaatcaccaaaaactttttttaattcaaatactacttcactatttaagtcaacccacatatgtcgtggcattctgtaattttttctatcattggcagtaaatacatataaagcagaatcacctttatattcagaaactacatcaattagtttaggcttcatctctttagccatttgtaaatcatcaactcttatatacactttatcactatttactttttctaaaggttctatactttcacaaataagttttggttcttcatcttcttttatattaaccctaccattaataactaccatggaatctaaattaattaaatttctaactttgtctaatgttttagggaaaacaactacttcaataactccagttaaatcctctagctttaagaaggccattattgagttatttctagttaccttttgatttacctctgctaatattcctcccaatattactctttgattatcttgaattaagtgatcatcatctcctaatccatccataatagcttcatatgattggaatatagtttcaacagtagtcgatgtcatcatctttaaacttttttcgtattcatctaaaggatgacctgatatataaagtcctgtcatttccttttccattgataataaattattttttgcaaactcttttatatctggatattttatttcaggctcctttatactctcctctgctataccaaaaaggctaatttgcccatctatatttctctttttttcattatatatgctatccattactttttcataaacagctagtaattttgatctgtatattttaaactcatcaaaagcacctgcttttattaagctttctacagcccttttatttattgttgataaatctatcttactaatgaaatcaactaaagactcaaagttgcctttgctttttctagcctcaactattccatcaacaacatttactccaacattttttattgctgcaagaccaaatcttatactgtttccttttacagtaaactttgaatagctttcgtttatatttggaggtaacacttgtatacctaagctttctgcaaactttgtataatgtgctactttttcacttgttcccataacagaattaaccattgctgctatggtttctactggatagtaatgcattaagtatgctgtctgatagcctattactgcataggctgctgcctttactactcttactttcataagcctttataaaataaagttgtagtctggactataccatatactaatttatttagtatctcctattatagtctctgagcgtctttcataataataatttatattttctttccattccaaaaggtttattatataccttattttttaaaacttctaaattatatttttttgcacttcttataatataaattccgttaaattcattggttataaatcttgcctctaagtcctcaaatcctaaatatattagtgctttcttacaccattttataaattcattagatgcagatgaaataaaaaactctcttccgtcttttcttatccaaccatctccatctattattccccttactatatacgataaatactttatttcaccatcatataaatcaggacctattaaagaaaatgttttttttgcagtaacacctaaccttttcatttcttctaataattttcgaccatataaaataattctatatttgtccttatattcagattttattactttataacttacatttaagtatttacttaaaaattcaattacatctttatcagctaagtctattccaacgtatcctctttcttcattaacatatccatctgttaatattaatcctaaaaaatatgctttatattcatcatctataactttcattgaaaacttactataagctttattttcactttgcacttcattccaatttcttctctcgatattaaacttatcaagcttttgtaaaatagagtttcttgttttatatccataaattttagatatctcattagctgtaaacccttgcttatataattttataatatcatgttcatcatttctatcaataaatgattgtttatacatattttgggtctctttttttattctatttctacatgcaaaatctcttattctactaacagtcaaattatatccatacttttcatttaaatatataactaacttttctgtatttatatattttttatataaatacagaatcttctttttatctacttcactatatttttcataattaatcggaattttattaataataatctttaattctataatagtacaattaatatcgtaaacttcttttaacgttctttttatttctctttcatttactctattagttcttaatttgtatataatttttaaagttctattattcatataaactatcaccttagaaatttcgttgctgattatccatttttattttacccaccatgtaaaacaactatacttagggtctccccatatataatctatttagttttttctgcatttctgccacattcacgcatatcttttcaaattacgttgtagtctaaatagctttaggaacttccagcaatttaaggagttttcaatataaatttctttatattgccacactttctattttatgggatttattaaaagcatacgaagcaaaatccatcatctgatcgaaaatttcatttgctgctttttcacttatgccatttctcagacaacctggtacttctacattaccattttcatctactattccatatataaaattctttctttcttgctccatgacactgtgctttttctttgacatggctcttctaaccatatcacttcttccaagtgagtatccacctagatctctaacaatctgcataacttgctcttgatataccattaccccatatgtgacatccagtatactttcaagttctggtgtctcataacgcacactgtctttatttcttttaccttctatatatctcggaatctccgccataggacctggtctatataaagatataccggctataatatcttccaggcaatctggcttaagttccttcatgaatgatgtcattcctggagattctaattggaatacaccagctgtttttccttcaccaatcatgttatatacatttttatcttcaaaatctattttatctaaatcaatatctattccttggttttctttaatcatcttaacagcatcactcataaccgttaatgttcttaacccaaggaaatccatctttagaagtccaagctcttctaatgttgtcatatcaaattgagttactatcatttcatcatttctttgaagtggtacatattcaactaatggctttgaagctataactacaccagctgcatgagttgatgaatgccttggtaacccttctagagttttactaacatctattaatgttttcactctttcttctgtatcatatgctgccttaagctctggatttaaatctaatgccttttctattgtgattccaagcattgtaggaatcattttagctattctatctacttctccatatgaatagttcatagctcttcctacgtctcttaaacacaatctagccgccattgtaccaaaggtaattatctgtgatacatttttaactccatacttttcaacaacataatctattacttcctgtcttctttcataacaaaaatccgaatctatctattactaccctctctttcgagatacttaaacactacttttgtagtgggtatagactatatcttcacccaccgacctttatacggtttgggctgccccacttcgctatgtttcataaacatagctacgtcccctcggactagtcgttgaacgtttccctattcaggacttcgctgcttattacccaatctattaatttttcaacattcacgtttaagcttatttcatctttacgttgtagtatcaatagctctaagggctttcaagcaattcgaggctctttaagtatattatttctaatatacacgactattaagttaaaatgtagatttcaaatttatatatttgatatattttctatctagataaattgtagaattatcatataaataactcattatattgaatgtttttaaacgcccaccgtaacttatataatagttatttttctcatcattatatcttttaaataatcttttattatacttatattcagaaactgtgttaaagatatctactatctcttctaggaactctttagttccacaaaacttaaaatttatagaattactcgataacactaaacttccatctccatcaaaatatcctctaataaaatgtctatataaatctctatttaatatttttatacttgggaatgtcagttttaatgacttattagctataacacctttttcctttatatctttaactaatttttcgctatttattaatattctacaatatttgcaactaccataaaccgagttagatacatacgatttaattttataatctgaacctatacatttcttgaatttttctaaatgcatcctatctaaattagctaatgctattcccaatttgcttccagttacgtatccatctgcataaataaaccctaaccaatatgctttttcttcagtatctatttccgaaaaataatcatcattcaccgaataaactaaatgactatcccttaaatttctagtactaactttccatctttttaatgcatcatagataccacataaactacatccaagtttatctgcaattttactacatgataatttttcatcaatatataaatttataatttcagccttataattatccaactcatatcgcttcaaaattctacactcctaagaatttaatatattcttagtataaacttctttttaatctggcatactaactctttccggatttaaaaatctttcaaagagcaagctatactttatcggattaatttttgttattcccagagtataagcaactatggaacctgctgccgatcctcttcctggtccagttggtattccatgatcatttgaatacttaataaagtcccaagtaatcaagaaataatcaacatatcccatttgattaattacaccaagctcataatcaagcctatcaacataagtctttgcttcttcattagtttcagcaaagtcctttatatcttgaacattaattaacttatctctaaactgttcaaagacatcatatctttcaaccaacccctcaaagcacacctcttcaagataatcaaaatgagttttatactcctgtggaactgggaaatttggtaacttagatacatggaattcataatcaaaattacattcatctgcaattttaatagtattttctaatgcctctggaacataagaaaacatatcccacatttcctcttgagacttcaaatagaactgatctgaaggatatcttcttctatttgcatcttcaacagttttacctgtttgaatacacataagaatatcatgagctttagaatcatcttgattaatataatggacatcattagttgcaattaaaggtattccagtttccctagataacttaatattaccttctgtaacctttctttgctcctccattccatgatcttgaatctctaaatagaaaccatctttaaatatatcattatacattaaagcaatttctttagccttttcataatcatcccttaataaatttttttgtacttctccaccaagacaagcacttaaagcaattaaaccttcactatgttttcttaaaaaatcatggtcaacccttggcttatagtaaaacccatcaattgaagccgctgatactattttcattaagttttcataaccaacttcatttttaactaataaaactaaatgatatgttccattatccttatcattaatcttaatattcatagacttgcttgctacataaacttcacaaccaagaataggcttaatcccttgtgctatagcttctttataaaaagctacacacccatacattacaccatggtcagtaattgctatactttccatacctagttccttagctctgctaatgacctttttaatcttagccgaactatcaagtaaactatactctgtatgtaagtgaagatgacagaactttttattttccaataaaacacccccgttttaattagttaaaggtttttagttaatagtctagtatataaattccaaaaggatttatatactagcgcttaactattaactattaactattaactattaactattaactaactaatagtttccacttctaatttcttctgctattttttctatttttcttagcctatgattaattccagacttaccaactggtggatctagcatttctcctagctcctttagagattcatctggatagcttaatctaagctctgcaacttcttgaagatttttaggcaatctttgaagtccaatactattttgaataagcttaatactttcaacctgtcttactgccgcattaactgttttacttaaattagctgtttcacagtttacaagtctatttacattgtttctcatttccttcattattcttatattttctaattcaagtaatgaagtatgagcccctactatgtttaaaaggtcaactatttgctcaccttctttaatatatattataaaactattttttctttgaataaccttcgagtttaatccaaaagaattaattagttttgataaatcaattgcatattcttcactatgcgttacaaactctaaatgatatgtcttttcaggattagttacacttcccccaccaatgaaagctcctctaatataagctttcttatactcttcagtctttaccatttcaggatcaattttataatcaatagttagtactccatctatttctttgaaaatccctgtttcttgaagtaagtccctaacccccatatattcttctattaaaaccatgtagatattattcttctttaatgaattactcttcttaaccattaatttagaatgtatatcaaagtgttcctttagtaaagtgaatatatgtcttgctgaagctggattttctgttgtaattctaaagctaagaccttttccactaaatcctatagttccactacctttcattattgctgaaagctctgctaatgcttcctctttcgatatatcagtatatctgcatatttctccttttactttcgctgaaaacgacataaattttttctcctaactaactataaatatataacacattatatcataaactgttcctactgtgtcataatataataatggaaaattactttaaataaaaatagaggatattgcctccccaatatcctctattttcctttactatttttaatttttttggaaacatacatatattccattatcttcttcttatcatataataactttttatcaagaatagttgtcattaatacttgtgctaaatagtctgaatcatgctttacatatcctttagttattttaactaaatctgtttctactaccttaacccctaagtcctttatattttcataatctaactcaactaacttagagccttcacttaaatatctttcttctatatccttagggattgtcccgttatttgcaataacatattcaacgctattctttccactatacttcattaatgtttttatatgatcagacacagcaaaatcatcagtttctcctggctgggtcattacgttagaaatataaattttaattgcatcgcttttatttatgcactctgcaatatcctctactaaaagatttggaattatgcttgtatataaacttccaggccccataacgattgcatctgcatcacttatagccattaaagcatctaataaaggttttgccctttcaggctcaatctttaatttttttatcttacttttttgtttgataacttcatcaggtattatagattcaccttctataatacttccattttcaagttctgctactaacttcatatcatcaagagtaacaggtaatacttttccagttacagcaagtacagaactcattttttgaactgcagcctcaaagttatcacttatcccatccatagcagctaaaaatagattaccaaagctttgtccctttaaagttccctctgtaaacctatattgaagtaaatcctccattattggctcagtatcagctaaagctaaaatacagtttcttatatcccctggcggaagcattccaaggtcagccctaagctttcctgaacctccaccatcatcacctacagttactattgccgttatattattagtgtatagcttaagccccctaagcattgtagataaacctgtacctccacctataacaacaaccttaggtcctcctacatgaaccctcttctcatcaactaaatcctcaatatttttatcagttatagttattttaatcttttcattatttattaatgcaataaatgctcttataaattctgatagggctatatatataattaaaagcccaattaaacttaaaaataagtataaaactttaaatcctatattgggccccgcctgtgaaaaaattttaataaatcctactaccgataaaatcacaccaataaaacctaaaaaaatccatcgttttatttttataccaggcttcatcaaaaactccattatcatagttttttatcccctttatgaacatcttctttaatatccctatgttctatataaacatcgtaattcttttcatgtaaactctgataaatttcatttgcaatagcaactgatctatgtcttccacctgtacatcctattgatataataagctgtctcttaccttcttttttgtaattaggaattaaaaattctaacatatcagttagcttatataaaaagctctttgtttcatcttgttgtaaaacatagtctttaactggagcatctaatcccgaaaaaggctttaattctggtatataaaatggatttggtataaatctaacatcaaacactaaatccgaatcaacaggtataccatatttaaatccaaaacttaatactgtaattgacatttgcttttctggcagagtttcgtcaccaaaatacttagtcatttcttctcttaaatcaccaattttatattttgatgtatctatgataatatctgatttatccttaacctctcttaatttttctctttctaattctattccagttataactcttcctccacctgataatggatgacttcttctcttttctttaaatctctttactaatacctcatctgttgcatctaaaaatagtatttcatatttaaattgatctttctctagttctcttaaactttggaataaatcattaaagaatactccacctcttatatcaattactaatgcaaccttatcaacttcaccgttactttttgaacaaacttctgcgaactttgtaattaatgttggtggtaaattgtctatacaaaaataccccatatcttctaagctttttgtagcttctgatttacccgcacctgataagcctgttactataatgaatctcatataatacctccaaaaacttctgctttatttaatcctatgatataactttaataaatttaaacttatataattctgtatagaataattatatcaaaacagctttgcttttacacgacttaattgagtaaatagaatatttaggacacttcataaattatttataaggaaactccttctcctattcgtctaatgagtaagttctgctaactaaatctaagatttagagcatcacttatatcaaaacagctttgcttttacacgacttaattgagtaaatagaatatttaggacacttcataaattatttataaggaaactccttctcctattcgtctaatgagtaagttctgctaactaaatctaagatttagagcatcacttatatcaaaacagctttgcttttacacgacttaattgagtaaatagaatatttaggacacttcataaattatttataaggaaactccttctcctattcgtctaatgagtaagttctgctaactaaatctaagatttagagcatcacttatatcaaaacagctttgcttttacacgacttaattgagtaaatagaatatttagaaaccttcacgaattatttttaaggaaactccttctcctatccgtcgaatgggtaagttctgctaactaaatctaagatttagagcatcacttatatcaaaacaaatttgcctttacacaacttaattgaataaatctaggcataaaaaaggttgccctaaggacaaccttttattcttcaccaattattctaacttctggatgaagctctactccaaattgactcttaacttcatcttgaatatattttattaaatcagttatatctttagctgtagcatttcctttattaattacaaaacctgaatgtttttctgaaactgctgcacctcctatagaataaccctttaagcccgcatcttgaataagttttcctgcaaagtaccctgtaggtctcttaaatgtacttcctgctgatggatattcaaggggttgttttgactctcttttattagttaaatcatcaactaattcttttattgtctttacctgacccttttctaatttaaatacagctgataatactgtatatccttttttcataactattgatgatctatatccaaaccctaaatctttatttgaaagtcttacaatattgcactcttcatcaattatttcagcactttcaataacatgggctatttcaccatcataagcacctgcattcataaatactgctccacctatagtccctggaatcccacaagcaaattcaaatccagttaatgaattttccatagctttatcagaaaccgctttaagcatagctccacattctgcttctattttatctccatctacaataatattgctaacctcttttaaagaaattacaacacctctaaatccaccatctctaactagtatgttagaaccatttcctattaaataaaacggaatattgttcttcttacaaacttcaacactttttattacctgctcctttgattttggagttaataatatatctgctggcccaccaactttaaaattaacgtaactacttagtttttcatctatcttaatatcatttgcatcataaaattctctaaacaaccctacaaatttatcgtatttattcatgacaagctccttaaaattataaaatatttacattttaatagtataaattaatttatactattaaacaagtgatttagttttaattattaccattaaagtaaatataaatactttctgctgattttttatctatagatggtgtatctaaaagctcttctatcgttgctttctttatattgtcaacgcttccaaacctcattaataatgctcttcttcttttctctccaacattaggtatatcatctaaaattgaatgtaaagttcttttatctcttaagcttctatgatatgttattgcaaatctatgcacctcatcttgaattcttcgaataagctgcattaaatttgaccctctatttataatcaactctttattattatatactatccctcttgtttggtgtttatcatccttaactagtccacaaactgaaatatctatatttaatgactttaacacctctaatgcaatattaacttgaccttttccaccatccatcattattaaatcaggaaatgttgaaaacttccctgctgataattttaaatctctttgttgaatagcttttatttcatctaacccatgattaaatcttctagttaatatttcacgcatactatcataatcattagcacccttaactgtttttatcttaaatcttctataatcgctattttttgctcttccttcttcaaatacaatcattgttccaacagaatctacaccctgtatgttagaaatatcatatgcttctattctagaaggccattcatctaaatttaatagttcttgaagttctaataaagaaactctatttaattctttatcttttaaatatttatctttaaacttttctaatgtaattttagcattgtttttaaccatttcaagcatatctttcttttgtcctttttgtggtactttgatacacaccttagaacctctttttatagtcaaatactcttccattagttctagttcgttaatttcaggcacaaaaatagtttttggtacctttgctgttcctccgtagaatgtggctataaattcctctattatctcaccaattccttcatttgctgtattttcgaatataaagtgttctcttccgattattttaccctctcttgaaaagaatacttgaatgcaactatctttatcatcttgttctatattaatgaaatcttcgtcaccttccatagttttaaaaatcttttgcttttcgactatggcctctatagataatattttatctctcaatgctgctgccttttcaaactctaattcttcagaagctctttccatttcatcttttagcattttagttacataagtttctttaccacttaaaacatctattatatcactaatcatctttccatattcttctttagtaatatgcccaccacatggtccaaagcattttttaatgtgataattcaagcaaggtcttatattctctccattttctcttattgcaagcttgcaggttcttaatggaaatattttatatattaaattaatagtttcataaactgctgttccattagtataaggtccaaaatatttgcttccatccttagcaaaatttctagtaacaaatactcttggataatcatcttttatagttatttttataaacggataaaacttatcatcctttagcaaaatattgtacttaggactatacttttttattaaattacactctaaaatcaaggcttccatttcagaatctgtaacaatatactcaaactctgaaatatttttaaccattactcgtactttttcagagtgattttttgagttttggaaataacttttcactctattttttaatatttttgcttttcctacataaattacttcccctaaagaatttttcattaaatatactccaggtttatctggcaaattctttaaatgatattcaaaatcaaacattttagaatcctcccctctttagttaatagataataattaagagttaaaggttactataagcaaatctaaaattaattaagcttgcttttgtcccccttaactcttatattatcacataatttttttttttattttaatatcctaaaactgcctgccttacaaccttacttgcaacagttgccgctttacctgaaccagttccaccattttcaacaattactgcaactgctatttgtggatcatccattggtgctactgcaataaaccaactatgtggtgttgcttcgctaccatctggtaaagtatagtcagcagtacctgtttttcctccagcattagttccttcaaaggctggccatttacttaaattactgttaactaaattagccatatactcttgtacggtttctgctatatcactagacataacttgttttaattgtttatcatcaatagttttcactatattttgatctttatcaactatagccttaacaagtttaggctgcatcattactccatcatttccaactgtagctgcaactaaagccatttgcataggtgttgctaaaatactactttgacctatcccactttgtgctatattaccaatttctgaactatctaaagttggaaacctacttgaagttatagatatacctggtcctgttattacagaattaaatccataatcctctgctgtagatttaagtgtatcatttcctaattccatagctaatgtaccaaatacaacattacttgataccttataggcttgctttaaatctaatgatccataagcattatttccaaagttactcaaagatcttccatcaggaaatttgatttttccttcatcactaaaagtcctatcaactactgatggcatgttttctaatgcacttgttaatgttacagtcttaaatacagatcctggaggatataatccattaatcgctctatttatcaatggtgaatcatccgaacttccgctattagctgaattcatttcatctgctaaattattaggattaaatgttggttttgacaccattgctaatatttcacctgttttaggatccaatgcaactacagctcccttattatcacctaatgcatctgatgccacttgttgaagtgttgtatctaatgtagttacaactccattccccaccttatcatcttcttctgttaataaactaaaatctattttttctttaaattctttaaaattctctgaaaaattaaagcttcctgtattttctttatcattcttaatattttctactaatccacttaaatcaatagtatctaagaattttctaaagttattaccaaaagcattataagtagttaattcactattatactcttgttcaagaccagtagttccatatactgcacttgtataacctaatgcatgaacatataagttatcatataaataatctcttttttgagaagtttcatttaatctttcacttgtagttaatgctgttccatttctatcgtaaatagttcctcttaaaacttcattctttttagctataacccttgtattacctgccatttcattaattttaggacttttaattagttgaaaatatgcaatataggatatcaatgctataaagaaaactaagaaaactgtcattacatgcttaacactttttgctaaatcattcatatcctatgcctcctctgatattttttgcaatattcctaatgcaaaaaatattgttaatactgatgaaccaccataacttataataggcaatgttatacctgttaatggaataacagcaaatattcctcctattataactaatgtttgacatgctatcattgtactaaatccaactgcaattaattgtgaatagctatcttttgtaacaaatgctgctcttatacctctataaaataataagaaatatattatcattaatccaattgcaaaaattattccaaactcttcgcatataattgcataaatcatatcactttctttaacaggtaagttttcaaaatgaccttgccctaacccaactccaaaaagtccgcctgcagcaatagaatacataccttcgacgatttgataagatgatcctaaggcatatttccacggatctaaccaaatcttaactctttctcgtacatgcccgaacatggaatatccaactactgaacctatagccgctaatcctaaggcagtaaatacatattttctctttgatgttgtaacataaagtaatgttattgaaataccaaagaatattaaagcacttcctaaatctctttgaagtaccatacaccccattgaaaaacctgcaactaatgctggttgccataattgcttggcatctcctttaacattgtttttagcttcatatgttgataatgcagatgctaaatataatactaatgcaatctttccaaactctgaaggttgaaaagatataggccctattataatccagttctttgccccatataattctgtaccaaatattaatgctaatggcattaatattaaagttattatcatatatatatttttatattttgcaaaactctttaaatctggcaatattactactatcaatatataagctattatacctaaagctatccaaactaattgcttaatagctgtaactgtatttattctatataatgtcgctacccctactactgctaatacacttgcaaaaattaaaataaatttatctccatctggataaaatcttctaactacaaagtgggaatagcctattaatacacataagactacccccattattaatgcaaatttatcaaaaggttgttgtaaaaaacctaatgctgtgaaaagtagtaagcatagcagatatactaatcccagtaatcttttttctcgctttattgatttcatatcatcacctctattatctgcctgactttaaaactttaaaaatagcacttcctatttttacttcatcgtcagcaactagcttatacttttcctgtattttttcactattcacatataccccgttggtactatttaagtcttcaacatataaattattatttttagcatatatttttgcatgattacctgatacaaaaggttcagttaatactattgtattttctggcttccttcctaatgtaataattcctcttataggaactacagatccctgttctaacacggaattaactcccgtttgaataacctcaataccatatcttatgcctgagctgttgtttcttgcttttccaccggttttaacatctttatacattatcttcaatgcgtaatatataatgacatataataaaattataaaaattataccaaatacaaaagtaaccaactttccaaaactcataccttcacctcaaattaacgtatatttaccattatatattaaatcttattgtaaaaaataacaagtcatctaaggttaacttaataacttcttaagatatttccctgtgtgcgatttattatttttaactatttcttctggcgttccttgtgctactaatgtaccacctttatctccaccttccggacctaaatctattatataatctgcacattttatcatatctaaattatgttctataacaacaactgtatttcctgcttcaactaatctttgtaatatttctactaatctactaacatcatctacatgaagccctgttgttggctcatctagtatatataaagtctttcctgtacttctcttcgataattcaaatgcaagcttaattctttgagcttcaccacctgataattgagttgaaggctgacctaatctaacatatcctaatcctacatcttttagtgtttgaatcttattttttatccttgggatattttcaaagaattctaatgcctcttctactgtcatatttaagacatcatcaatatttttacctttatacttaacttcaagagtttccctattatatctctttcctttacatacctcacatggaacatatacatcagataagaattgcatttctatttttataattccatcaccagaacatgcctcgcatcttccaccttttacattaaagctaaaccttcctggcttatatcctctcattttagcttctggagtttgtgagaataactctcttattatatcaaatgttcctgtatatgttgctggatttgaacgtggagttctacctatagggctttgatcaatatctataatcttatcaatattttcatatccacttatctctttaaaagcaccagttgggtttttactcttattaattatcttatttaatcccttataaagtatttcatttactaatgtactcttaccagaacctgaaacccctgtaaccattgttaaaacacctaatgggaatttaacatttaagtttttaaggttattttctttagcaccagttactgtaataaaatttccattgccttttcttcttacttctgggacattgattgctttttccccagttaaatattgacctgtaattgattctttacatgccattatttcatcaactggtcctgctgcaattatttgaccaccatgttcccctgctcttggcccaatatctactatataatctgcttccctcatagtatcttcatcatgttcaactactataactgtattacctacatcccttaaattttttaaggtttgaattaacttatcattatctctttgatgtaatccaatactaggttcatctaatatatatagcactcccattaacgctgatccaatttgagtagcaagtctaattctttgtgcttctccaccagaaagagttcctgagcttcttgaaagatttaaataatctaatccaacattaactaagaattgtaatctactttttatttcttttactatttgatcacttataattctttctttttcagataatgtaattgagtttatgaagtcaagttcttctttaattgacattttggtaaattcatatatatttttgtctccaacagtaaccgctaaaacttctttattaagtctagcccctttacattttggacaagcattattgctcatatattgttctatttcaccttttataatatctgagttagtttctttatatcttcttataagtgaattaatttctccatcataagaatatgcatattttgcctttactccatctttagtataaataacagataacttatgtccattagttccatataataataaatctaaatgctctttagatagttctttcactggtctacttaagtctaaatcatactctttacttaatgcttgtaatatagcatatgtccatgaatcttcctttaatctaccttctccccaagtagcaatagctccttccataacacttaaattcttatttggaattactagatttggatctatttccattaaagttcctaatccatcacatttatcacattttccgtacggtgcattaaatgaaaacattcttggttcaaattcttgtatactaattccacaatccgcacatgcaaagttttcactaaataatatatcttcatcaccaattacatttattataactagcccttctgctaattttaatgccgcttctagtgaatcacttaatctaccttcaattccctctttaattacaagtctatcaaccactgcctcaatattatgcttcttagtcttttcaagctttatttcatcttcagctaactcatatatttcaccatctactctagctcttacatatccacttttctttatattatctaatactttttcgtgagttcctttttttccccttataattggagctaaaacttgaattttagttctatccccaagcgccattatttgatcaacaatttggtcaacagactgttgagttattacctttccacatttaggacaatgtggaatacctattcttgcatataacaatcttaaataatcataaatttcagtaattgtcccaacagtagatcttggatttttactagttgttttttggtctattgatattgctggtgatagcccttcaatatagtctacatctggcttattcatttgccctaaaaactgtcttgcataagctgataaagactcaacgtatcttctttgtccttcagcatataatgtatcaaatgctaaagaagatttacctgatcctgataatccagtaaatactattaacttatctctaggaatttctaaggaaacattttttaaattatgtactctcgcaccttttactataatcttatctttcatctttctaccctcttcgatatacttcattattttatttttatcataattctttttatttaatctcgaacaaatattctctttattatattttagatttattgatttttattgtcaataaatttcactatttatacaatttatagcataataaaaggcactttctttagtttaagaaagtgccttttattatgttagtttcacttaaaattatatattaaatatttaggtatcgctataaaaaggtcgtatttttacttatacattttattaatatctagtgtcttctaatccgcagaatgcatctactggacttacacccttaaattcagaacgtcccaccatcttatcaactaatgatttaagagtatagtctttattatcataagtatttatataagttttaacttgcggtacatcagctaagtggaatgggcattgtaccgaaacaaaaatagtaggtatttcattaacataaaacggaatatctggagtacctttgcttggtggccattgaagacgctgatcaacacttgctcctacatcagctatatttattattaaatcatatttagatgttaattcagctattggacgtttaccagcataaacattaccaagtgctgcacccatttcttcctttggtaacttcataatcttatctattggtgattcatatatttctacttcgaatccttcttctactaataactctttcattatatctataggtcctttttgaactccttgcataagagctataaacttaccaaatcccccttcaaacccttttgcatttacaagtaatactttcttagtcttatctggtgaaatagggaatatttcttgattatttttaactaaagttatacctttgtcagctatttctaaagctgctttcttattttcttctaaaccaatcttagccattgcttcttcttttggttgtaatatttcagttttagctttcttatgtaatcctaaagaagcttttaaacctaatattctacttaatgcatcattaagtctttcttcagttataactccatttttgtatccttccatcatccattggaaatcttcatctggatcattgaaaaataagaataagtcactaccggctgcaattgcagtaggtaacatatctttacgcttcatagctgaagtcatagcaaccatatgagatgcatcagttacaactaaaccattaaatcccatttgaccttttaataaatctgttaatacatatttgcttaaagttgcaggcatattcatttcttgaattgtagcttctggattaaatttctttacatattgtggtaaagcaatatgtccagccattattgatggaagacctgcttcaattaatcctgaatatacttttccgaaagtattatcccattcttctactgttaaagtatttggtgcaaatgataaatgttgatctctttcatctataccatctccagggaaatgtttagctgctggtaaaattccagattccattatccccttcatatattgtaaagataattctaaagtttgttcaacatctgctgaccaagttctagtagatattattggatttctccagtttctatttatatcaacgattggagcaaaactccagttacatcctatagcagatgcttcaacccctgagattcttcctaattcataagcataatgtgaatcttgagttgcagcaatttttacttcattaccaacataagtaccatctgtacatgctccatttccacccatctctgtatttgctgctattagtagtggaattttagaattttcttgtaatattctattttgctcatatacttcttctgccttacctggattataacgaacagctccaatgtgatagttatctaaaatactttttaaatactcttcatcacggcttgcccccatatttacaaatagttgtcctattttttcctctatagacatattagcaattgtatcttctacccatcttatagattcttcatctaaattataaggttttacttttaaatttaccattttagtttcctccctatatccaatattttctaagtatacgtatacttattgtcgctatttttattaagctaatcttctttttactaattctttattcatttcctctaccttcttcttagaaaggttatatataaatattagaactaatgtagttaatataaatcctccagcggccattcctatacctatattcttaataccaacaccgacactttctgcttgtaccgtaacacctgattgatatcctaataaagataatgcaaatcctcccataccaccagatataacttgtcctaattttctagctaatgaatatgaagagtaaactgtcccctcatttctttctcctgtagtatattcttgataatcaataacatctgaaactaatgcccaaattattgtatttactaaaccagaacctaaaccagctaagaatgataatgtaatgaatgtcattactgttaaattaggtatgaataacattactatatacatacaagctgcaaatgttgatcctaatactgctgactcttttttccctaactttctaactattgctcctgcaaatggtataacaacaaccgatgctaacataccaatcattccaccaatagcagtaagattagtggctttaaaataatctttaaataaatatacatttagactgcttaatgtaaatgtaccacctagcattaggaatgaagctattgcaacacctaaaaatgctctatttttaaacaataatcctattgtttctataattccctttttactattacttgctttgtgtactattctttccctagttaatctaaagttaaggaagaatgatactgttgaaattattgctaatactatagcacaagttataaatccttcagctgtaactttaccttgtgcattaaatattattttaggaactaataccattactaagatattagccaacatagatccaagatttctaaaagttgataaagctgttctttcatcagaatcattagtcattactgaagctaatgaaccataaggtatattaacagctgtatataacataccgtataaaatatatgttacgtatgcatatggtaacttaagattatctggtaaacctggtattgctgtaaaagctaatattccaataataaccattggtaagccgaatctaacaacatatggtctaaatttaccatgtttagtactttgtgccttatctaaaaggactcccattatagggtcattaaccgcatcccaaaacctagctactacaaataaagttccaacagcagctgcactaatccctaaaacatccgtatagaataccattaaataactacttacaaatgcgaagaatgctgcacacccaaaatctccaagtgcatatccaactttatcacccacattaaaagatttcacttgttcttcttttttacttatcaaatcaagaaccataattaatctatcctcccaaaataattctttttgaatacatttacattaaaacttttataatctcttaatatagaatggaaaattaatttatatagattttccattctatacttttaataattatctttcaaaatactttgctgaatttttataacaaatgttttctacaatttcacctagtatttcttcatcataagggtattgaccagactcaactaaaccacctaagtaattacataatattcttctaaaatattcatgtcttgtatatgataaaaagcttcttgaatcagttaccattcctacaaattgacttataagaccaagttgtgataatgccatcatctgtctttccataccatctttttgatcattaaaccaccagcctgatccaaattggatttttcctgctatattaccgccttggaaattaccaatcattgttccaatcacttcattatctttaggatttaaacaatataaaattgtctttggaagtttatcctctttatctaattcatcaagtattcttgaaagtgaatatgctatttcaccatcatcaatactatcgaatcctgcatctgctcctactctattgaacattcttgtattattatttcttaatgctcctatatgaagttgcattatcatctttctttctgaatacatctttcctaaagctattaacaatgcaatagaatattttgatgcttcttcatttgttatgtattcaccatttaatgctttaataaaaatcttgttaatttcttcacatgaataattataaaaaacaactctttctaagctatgatcagtaatcatacatccattttcataaaaataatctaatctaacttctagagccctttccaaatcattaaatgatttaatttcaatattgctaacttctgataacttatctatatactccttaaatcctttgttttgtatcttcattgccttttcaggtctaaagcttggattaactgaacactcaaaattatcatcttcttttatttgcttatggtactttaaatcatctataggatcatctgtagttccaatataaactacgtttgccatttcaattaacttctttgctgttaatttattttcttttattgccttgttacatttctcccaaataatatctgctgttttttcacttaatgtttcttcaacaccaaagaatctcttaagttctaaatgcgaccaatgataaataggatttccaattaaatatggcatcatctttgcaaatttataaaatttatcataatcacttgcatttccagttatatactcttcatctataccaaagcttctcatagctctccacttatagtggtcatggtatagccacatttctgttatatttttaaactcatgatctgtggctatttccataggaaccaggtgacagtgataatcaaacactggcacctttgaagcataattatggtacaaaacttttgctacttcattttctagtaaaaagtctttatccataaacttcttcattcttttatccccttaaaattaattattctttttatttttattaattgcctcaattaatccgttgatatacactgcacctaatgctctatcatataatccatatcctggtctaccagtttctccccaaatcattcttccatggtctggtctatatggacctgtaaattcataatcacagtatgccttaactatttcatagaaatctaaagatcctgcttctgataaatgagctacttcgttaaagctactatctccagtaatttttacatttctaagatgagcaaagtgtattctatttctttccttaccaaaatagttaatcatcttaaccatatcattaacttttgtacaacctaaagagcctgtacataatgtgattccatgataaggactatcatataaatctataaatctctttaagttttcaaaattagttatgattcttggtaatccaaatattccccatggtggatcatccggatgtattgccattttcattcttacttcatcagcaaccttcattattctttgtataaagtaatttaaattgctccatagtatttcttcatctatatccttatattgttctaataaacctttaagtccaccttcaccataagaagtatcccatcctggtaactctaattcacctaaagctggatccatctttttgacttgttcttcatcatatattaggcatgttgatccatcttctaattcataatttaaatcagatcttgtccaatcaaatactggcataaagttatagcatattgtatctatacctgcctctgctaaatttctaattgtttgtatatagttatctatatatttatctcttgttggtaacccaagttttatatcttcatgtacaggtacactttctattacagaaagctttaagccatgactttctatttcattctttaattctaaaattctttcaagcggccatacttctccaacaggaatatcatatatagccgtaacgattcccttcattcctggtatttgcttgatgtattcaattttaactggatcatctttaccataccatctgaatgtcatttccatgattttttcctcctctaataaataaatcactactttttaaaactcttggcacacttgacgaatactagtataccagctttgttaaaaaaatttaagctctaattttgtccatttttttcataaaagcttttgctgtattttctatatcttcaagtgatcctttaattaatgagcttccaactccaacgcaagaaactccattttcaaaccactcttcaatattgtcaactgaaactccccctgttggcattatttcaacacttggaataggtgctttaattgcttttacatacttagcaccaaaaacatcgcctgggaataatttaatcatcttatttccagcatccatagctttcattatttcacttactgtcatacaacctggcaaataaagaacttgcatttctttacataccttatcaacttcttcactatatcctggacttacaacatacttagcacctgcttcaattgcgtcgcaagccatcttagcatttaaaacgcttccaacaccaattaatgcttctgtatgtgagctatattcttttataagctcacatacatttgggattgtataagtaagttccaatgatttaattccacctcttaagcatgcttccatgtaacctctagcttcttcatggcttttacctctaactacggctacaattccatttgcctttaattcacttaaaatcatcttctcttatccccctatacccctgaatatgctgagtatgctccatctactggaataactactccatttacaaatcctgatgcttcttgagaaactaagtataataatgttcctattaattcatcagcttcaccaaatcttctcattggtgtactatttaagatcttttctgttcttggagttgctgttccatcttcattaaataataatcttctattttgatctgttacaaagaatcctggtgctattgcattaactctaactccaactttagacatatgaaccgcaagccattgagtaaagttacttacagcggcctttgcccctgaataagctgggatttttgtaagtggtgtaaatgcattcattgatgatatattaattattgtagcaccttccttatttatcatatccttgctaaattcttgtgatggaagtaatgttcctaaaaagtttaaattaaatacaaactctacaccttttggatctaaatcaaagaatgtagttaaatcttcattttctaaatcttcaacttctaagtactccttagttgtagttccttttggatgatttcctccagcaccatttattaatatatcaactggcccaaattctttaagaattatttcatgtgcctttcttaaactttctttatctaaaacattggcttcaataccaattgctgttccgcccttttcatttatttcttttgctttattgtcacaagcctcttgacctaatgccaaaattgcaatttttcctccacactctgcaagtgcatcagccattgctccgcaaagaattcctgttccacctgttacaacacaaactttattttttaaatcaatattaaaaggtaatttcattttacattcctccttgcaactactatacttgtatactagaatattaatatatgaattacaataactttttgaaaacatttaaatttttttatacaaaaaaagccatataatattaaattaaatatatacgaccttctcttatactataatttctaattttcataactaaatttattattttaaaaattttttatataaatttttataaattattatattaaactatataactagctatttctgaatcttcttttattattttttcccattgttccactggatcttttatatgctttgatacaacctcgtcaataatatcaacgtttttatttttaataatatctaaatacgttatgtgttgatctactaaaaatgctttatttaatttcatttcagctaataatctcattctattataatgagtacttatattacaaattgattcccatacatttgtcttgtttataccaacaaataatagcttatgaaactctttatctaaattatgaaactctaataaattatcacctttttgtgcaattaatttttgtgcaaataagcatttttccatttccattaatgtatcttctgaaaaattttcacatgcttctcttaacgcttctttttctaaattatatctaataaaaatagcctcttctattaaattccaatcaattagtgatacataagttcctgcttgtggcttaacttctattaatttttcagctttaagctttattaatacttctcttataggtgtccttgacacatttagtttttttgctaaatcagattcacttaatagttcaccaggctttagctctaaacacatgatattatcttttaatactctatacacatagtcttttccagtttctttatctagtttgtcataaagaatcaatttaacttaccccctaataatatttatcttcaatctagtacactagtatatcacattataacataaaaaaaaattaggtctatataatatacctaattttttattttaaactaatattattctattttttataaccgaactctggtatattagtccatctttcacgtaatgcatgagctatcattttaggctttctttctctagtaaatatacccttcttattaccttgaactcttataataccttgacttgtagcaaaatctgcaaaattccatgtttgttctccaacaaagtttttgcatttatctacaacttcatggttagctttataatattctacttggtattcttctgtaaacataactggaactgtatcatgtaaacctgcaacagtatctgccccatattcggtgaacattattggtttattagggcatctctcttcccatccctttaattcatcatcaagcaatctttttgcttcttctaaatctccaccagcaacataccatccataatatctatttaaacataatacatctactatatctccaactttacacttatcaggagtagacattaaatacgtaactacagtaactggtctcttttgagggtctaactccttagttaattttattaatggctcaaaatattcttttgctccttctgaatcagagtcaggttcatttgctacagaccacatcacaacgcatggatgattcttgtcccttgctactaactctcttaaaacttgctcatgagcttctttagtttggatttctttccatgtatctctcttatctacatctccaccaaatccagtagccataaagtttaaatgtactcctactgcaggtgtttcatcaattacaactataccttctctatctgcaagtctcattatttcttctgaataaggataatgtgctgttctaaaagaattcgctccaatccatttcattaaattgaaatctttaatattaacagcttcattcatcccccttccattaatataagaatcttcatgcttaccaaagcctttaaaatagaacggtttattgttaattaagaacttaccttctttaacttcaacttttcttactccaaactcttctaagtaagtatcaattatagagtcattgtctaatagctctacttttaatttatatagatatgcattcattggttcccataacttaacgttatctataactagttttccacactttcctgttgcttgtgaaactacattattatcttcatcaattattgatacactaatgttaccttctcctactgttttaatttcataattaacatatcctgttgcttcttcaaaatcagtaacaatagttatgtcttctacataattctttggagttgtatatatttttacaggtctatgtattcctgcataattgaagaagtcaaagttaactgaattcttaataactttttttccatcaatctctacttcttttactaacccaactggtaaagtagtttcatcgattatattatttacagcaacagttaatctattttcaccttgtattagtaaattatttatttctgcttcaaatggagtaaatccacccttatgctcaactaataattctccatttaaatatacttttgcttcatgagtcactgacccaaatcttagcactattctttcattcattaaaaatttaggaataacaaaatttctttcataccatacccagcccacatggtctcttacttcttgactttctactaagtcattatatgatgctggaacagccatttccattgtttcttttagaggcgtgttcttccactcctctgtaagactgttaccattgtctaatttaaatctccatatcccatttaagtctattaattgtcttgattctgtaattattggatataacataataacccctcctaaaatttgttataatttatttatatttttattgttagctataaaaaatttttttatcttttaacattgcataagccattatcaataaatgaattaattgtatcttcatcaataatatttatatctcctattattgaatgctttaatgcacttgcacatgtcccaaattcaacgattctctcattttccatttcatttaaaactccatgaagtattcctgctgtaaaagcatctccaccaccaactctgtctaatatatcaaatgtatacttatttgatttaaataagttatttccatcaaataaatatccctgtaaagtattattatttattgaatttacagttctcttagtgcatgatgcaaaccttaaatttggatactttttaaataaattttcatagtgatactttaatctttcttcaaattctaaattttcatcctcaaatttaagtatatttatcatatctagatagcctaaaaaagcaaaatctatataaggtaatacttcttccaatacttcccttgcttcatctatagaccaaagctttgacctataatttgagtcataagaaaccaatatcccttggtttttacactccttcacaatatcaattataagttccttcaaattactacttaaagctggtgttattcctgataaatgaactaatccaacaccttttagcatattttttatattaaattcttctttttttgccatagaaatggctgaatattttctatcatatataacttcagtacttctaagaccatgtccaatttctgaataatatacacctaatctgccttgtcctattatgatatcctctacattgacattataacttctaaacttacttataacttttttccccaaataattatctggtagctttgttataaatttagtatcatggcctagtatagcaagacttgctattacatttgcttctcctccagaatatacagcttcaaaagaatctgattgtattattttttgattattaggaggagtaagccttaacattatttctccaaaacctaatatctttttacttttgaactctatgtttttcaccttaactccaccctttacttaaattatatatgatttttatttagataagtttgatttaaattcatttataaccttctcttgatactcccctatatatgaattatcaacaaattttttcaaagcctctctagtaaatctattccaagactccttttcctttttaaccattattggataatataaaacttcatttgattcagcagctttaagatcccctaaagcatctccaaccattaaaacatttcttctattatatcctttttcaataagcttacttatacaataggcctttgaaccaacattttgagttaaaactatatcaacgttttctaaaagtccattatgactccattcatctaatactgctttttcatttgcagatgatactattgctatatctgcaatttttttagcttctattatagcttccttcacaccctcaaatgggcatttttcctcttcacttaataaatcaatagatttattgacagctcttgaccattctaaagcttttcttatacaaatgttgtttgttgttttctctatttctttttctaaagattcattagacagttctaaggttttctctgtccactttaaaaactcatctaatccttcaatttttatatatttatcattaatttctgtaagtgctactgctaatcccttaaatctatttattcccctagttaatgtataaagattaactttattccaactatctaatataggttccctccactcttcaagatcccattcagtaatcatacaaggtccaaaacattttatatgctttatatccatagtatctattgcacatccatcagaatctatacaaataagaaaatctttttgtttattaaatttttctaaaatattccccattacttccacctactattaattgttttaagaccggccatagttcatgttaataaatctgtgttaagtttaatattttatgaaaggtgtttaagtttaactatgtggtgtctaagtttaactatgtggtttttaattaacaatactcttatagcctagtcttataaaaataaattttcatcctcttactagtatactagcatattagtatttttatttcaatgattttcgaataccttttcatttatttataaaaaaaatacaagcaaatacttttcttaaatttgcttgcatttattataaatatttttatcctatttccataaaatttgtattgtcaattcttcgttttttaatgttgaatttatactacatcctaatttttctactaaaaccctagttatatacaatcccaatcctgtatttctatcacttcttgatttatccacagtatagaatctctcaaataatttatccacattttcttccattaaatctgttgttttgttaataaactctgttattattacatcatccttttgttttaaagtaatttttacataactttcaccatgtttaattatatttcctattaaattagtaaaaattcttgtaatagctccttcatccgatataatttctctaatattttcgtctacttcaataatcggattaatattattattaataaaatcattgtaaaatgcggctatattttcgcataatatgttttttaaatttacctttttataattaaagttatactcatttccctctattctagataaatcgtaaaaactactaataagctgttgtaatgattttgctctattttctacaatatctatatactcatttttttcctcttccgatataccttctaatcttgctatttgcaaatatcccattattgatgttaatggtgttcttaaatcatgggacatattagatatactagcccttaattcttcttcgttcttattcttctctgcaacaatcctttgtttagaatcaaaaatcaaatttatattttcaactaaagactctatatccttatctacagattttgtttttatatttacatattcatctaaattattattaatttgcttacttattcttttaaattctcttttatatcctataataacagctattaaaacaataattattgctattaaaatacacgttatccccatattctctcctattctatatataaattcattacatatatgcccttagatatactccctcataattaaaattttagattttattaattaaacttcttaatttatttgtatataaatgcaaatttaattttattaatgtcaaaattaaaattattctttaagtatactatatgctctatgcttaatccttccaacagtctataaatataaacaagccacctcaagagaatgttctaaaaaataaacttttctccgaggtaactttttttacaatctattaaacttttcactacctatattattcaataccttaattgaaccaaataaaactattaaaaacatcattaatactgtacttaaaataatcatcatattggtaatattgaatacttgcactaatgcaacagctactcccacaactactaatattaatataaatactaataaaatagtaactaatacacttgcgctttgttttactaccgttgttggatttgtccattccatctttggaaaatataaattggttattatccctattatagctgatataactgcaaatactatgctaattattaaattgaaaattagatacttaatctcgaattttaatcctatataaaatattatattagctataattgatgctggaattgttattattaaattagttattatctttcccttaaaaatatccttaggctctattggtaatgattttaatatccataacctatttccttctaatgatattgatgagtttgttgtacaagataatcctatagtaaacactaatataactaatactcctatgggaattatattaactatttcaggatatcctaaaaatactgctaatgtttccttgcttataaataatgttgctatagctgctgcaactaataataccattccaactgctgtgttcataacataaataggtgttgcaaaatatcttcttagctcctgtgtaactaatgcttttgttatactgcttgcttctaattctgccaccttataatttgccttcttatagctttctgataatttcccatttatagctttaaatgtcttactaaacactaaaacaaatattaaaaatggaactgttgatattagtataaactttattaaactaactatatcataacttactaaagcttcttttaaatacattgcaggtgggtatattctagataatccatttactattgaatcactatttgcaataaatgcattaatataactttgcatattcattaaaactatcataattaataaaactgctatcataccaacaattgtagttgctatatttttatgcttaaaccttgatgatacaaatgttatagcaacagctattattgaagctgctattattgggagcattggtataaatattaatcctattattaatataatgaagaaaatccatgataaacttccattataaataaaatatactattgaagctggtactattataagtgctgttcctatataacttatagacattaaacttaatattttactagttaatattgtactattttttataggaagagccattaatacgtcataatcttttgagctaaacaatgttccttgtgctttataaattgatgttataaagcttaaaatacatgaaaataataccgcaattattaatattaaatctaaatatcccattggttttaatactgtagctaatccaattgagtatgatgtggccataaaacatattactattgctattaatactagtgttgctgtactaattaataatttctttttttctttagaagtacttactcccttagatagtgaattaattcctgtattatttataaatgaattttttaataaaataaataaattactcattatcaatcaactccataaagacatcttctagagaattattacccttaacttgttcagtagtaccctctgcaactatctttcctcccttaataattgcaatcttatcacataatttttccgctacctctagtacatgtgttgaaaagaatattgcactcccttcattacaaagctctctcattatctctttaagtgtatgggaagccttaggatctaatccaacaaacggttcatctaatattaataactttggtttatgaattaatgcagatattactgctaacttttgtttcataccatgagaatatgaagaaattaaatcccctagatatttagttaattcaagtttatcaccataatacttaattaacttttctctttgttctttacttattttataaatatctgcaataaaacttaaatattgtattcctgttaaagcttcataaagatccggattatctggaatatatgccattatctttttacattctactggattgttcttaatagatttactatctattaatatatcaccttcattaaattccaatattccgactatagatttaatcgttgttgtttttcctgcaccattatgccctataaatccaaatatctctccactatttacagttaaagatatattatcaactgcttttttaccttttgaatattcttttgaaaaattctttatttctaacatactatttctccccttactcatcaccatttttataacagtcttataaatttgaaagtaatgtaaaaacttgaattactatagctaataatgataaaattatatgcctttttatctgtgctgattcaccatttctattaggcaaaaatcctaatttaatattaatcatttcaagtaactaacctttattattttatatcttgagccttaaatattcttattcctacaaataatgaaattcctattgttactaatgaaattattactgatcttagtaaatctccatttcccgctttaattgaagttgctaatgctgaattataaaatggtaatacttcataaatcctatcaaaccaaggatatattccgtataagaatcctgcaaatgttggaacccctataaatattgctactgttattcctattgtagttccattgctttttactaatgttgctataaccatagccaatgctgctactgctgaactagctataactgacaccataaatgtttttatcattcctactaattgtaaaaattcaaaggtttctccccatccattcataataattacaattaccgttggtaatattgtcataactgctgatattattgcaattgctacaaccattgctacaaattttgctagataaaactcttctctttttttgccataagctaaaaaattctttattgtcccttgtgaatattcctttgccattaatgctgctactaatattcctattaatatttccatgacccctgaaccaaatgaggcatgatatacttctatggctgttggattcatcatatctttagcttttaagtgaattcctacttcacctggtgttactattgcatcactatctgacattgctgtcatttgctccataagcattgctttttgttcttctggcatatcacctaagctatcactaagtatttgttcaaaaataggtgagcacataactactgtcaatgtagataacaaaactgtaacacatattagcaccgcaaatgttctatttttaaataatttatataattctgcttgtattgctttaatcattcaaaacacctccaactgcattcataaagtactcctccaaattttcccccttaacacttataccttcaacaataattccagcctttgaaagcattgaatttacttcaccaacattatctaaattagaaaatacctttatattgttatcctctaacacctcataatcacttattcctagctctctttctaataaagttactgctctagctgcatcatctacctttaaatctatatattgtctacatttttcagatagttgtttagctgttatttcttcaattaattttccctttgagattattccataagttgttgcaagttctgataactcacttaatatatggcttgatattaacattgtcatgtccttttctttatttatcttctttaataattctcttatttcaacgattcccattggatcaagtccatttataggttcatctagtataagtaatttaggatttcccattagtgcatttgcaatccccaatctttgtctcattcctaaagaaaagtttttaacttttttcttttcaacatcctttaagccaactaattctaatacctcatctatacatttctttcccggtatattccttactaatctagatacttctaggttttcccttgcagtcatatttgtataaaatgaaggtgtttcaattaaacttccaaccattgttcgcgctttatttaactcattttctccatttgcccctaaaagctctatttctccaccactcttatgaatcaatcctgtaataagtctaattaatgttgttttaccagcaccattttgacctataaatccatatatatctccttttttaatagtcatattaatattatctacagccagttgttcaccatatttcttagtaatgttatatgtcttcaatacaacttctttcatttttatttaccccctaagtaataatttatctatcacttcttttttatttaaattcttaatttacttacattgtatattcatagttgtaagataccttaaagaaaatattaagaaagtattaagttttcagagataataaataagattaaaaaatggttggtagaactaattaatttttctaccaaccactatttaaattgtataattacattttttaaatatactatttcctattgtaattttctttcctacagacttattgtttagttctttactctcaatagattcctttgttacttttacaagtaattgcttctgttctaattcaagcaaataataagctacccaattactagcataatcagctaattgtaatactcctggtaatgctataaaatcagttattagttattcttttaatttaaatccaattccccatactgtttgtatatattcattttccttatctatcttagatatctttgatcttaaattactaatatgtacattaacagtattgtcatctccaataaattcatctttccaaactgattcaaataaatttgctcttgtaaacaccttattaggattattaattagcaattccaatatatcaaattccctaactgttaaatttatatctattccatttacctgtacttgtctactatctatatctaaagttaaatttttatgagttaatttattattacttctttttttagaacttgaaaatgctgtatatctccttaattgtgcctctaccctagccaagacttcatttatatcaaatggcttgctgataaaatcatctgcgcccatctttaagactccaattttatcctcttgggttgttttagctgatgcaactattattggcattatataatcttctctgatttcttttattaagtcttctccacatattcctggcaacattaaatctaaaattacaagatcatattgagtctgctcaatacacatctttgcttctgacccggaatatgcaccccttacataatatccattttgacttaatatcttacataatagcccatttatatcccaatcatcttcaacaactaatattttgttacttgaattcataagctatccatcccccatccccataccaaataattatttaaattatatcaaacaattatacttatataaattaatatttattaaaaaaatgattcctacattacataggaatcatttaacataaattaaaaatatatattggatatgagtgttttgttatatttgcaaaactgttcaagaacagtatatcatatatactattatttaaattatgatacttttaaatgattcttataagaatacttaatgcaatttcctaggaaattatttttccttcaaatcattaatcatatctctaagctcagctgctctttcaaattgaagattcttagctgcatctttcatttcttcagtatattgcttaattaacttcttcttctccttctcagttaaagtagaagattccttactaacattatattctgaagaatcttctgcaaccttcgttgcttcaattacatctcttatatccttaataattgtctttggtacaataccatgctcttcattatacttcatttgaatttctcttcttctgtttgtttctttaatagctctatccatagatccagtcattttatctgcatacataattactttactttcagaatttctagctgctctacctatagtttgaaccatagatgtttctgaacgtaagaatccttctttatctgcatctaaaattgcaacaagagcaacttctggaatatctaaaccttctcttaaaaggttaattccaacaaggacatcaaactcacctaatcttaaattccttattatctccattctttcaatagtctttatatcagaatgcatataagtcgtcttaattcctaattcagttaaatacttagttaaatcttctgccatcctcttagttaacgttgtaactaaagttctaaatcctctttctgttgttttaattatttctgcataaaggtcatctatttgccctgttacaggtctaatttcaactacaggatctaacagtccagtaggtcttattatttgctctgcaatattagtcgaatgatctaattcgtattgagctggcgttgcagaaacaaagataagctgattaattttactttcaaactcattaaatttaagtggtctattatcataagcacatggaagtctaaatccatattcaactaatgtatcttttctcgatctatcccctgcatacattgccctacattgtggtaaagtaacatggctttcatctatgaacattaaataatcatctgggaagtaatctaataaagtctttggtggtgtacctggtgctcttccatctaaaactcttgaataattttctattccactacaatatcccatttccttaatcatttctatatcgtaattagttctttgtcttaatctttgagcctctaataacttatcttgagatgttagctctcttaatctatcttctaattcatcttcaatttgctttattgccttatttaaagtttcttgagatgcagcaaagtgagaagctgggaaaatagcaacatgctctctttcacctaatatctttcctgttaatatatcaaactcccttattctatcaatttcatcaccaaagaattctattctaattcctttagttgaagatgaagctggaacaatatctaatgaatctcctctaactctaaatgtacctctagaaaaatcaatatcatttctttcatattgaatttctataagtttcttaattatttcatctctttccttttccattccgactcttaaagaaatagttaacttcttatattcatctggattacctaatccatatatacaagatactgatgctactattattacatctcttctttcaaataatgctgacgtagccgagtgtcttaatttatctatttcatcatttatagaagcatccttttcaataaaggtatcagtttgtggaacatatgcttcgggctgataataatcatagtatgatacaaaatattctactatattatctggaaagaactctctaaattctgaacataattgcgctgctaatgttttattatgagctaaaactatagtaggtttttgtaccctttctattatatttgccattgtatatgtcttaccagaaccagttactcctagtaatgtttgatatttttcatttttttctattcctgagactaaactatctatagctgtaggttggtctccagttggtttaaacttagaatgtatcttaaattctcccatgtatatcaactccaaatttttcttatttacataaatacattttactttctatcttcaccattttcaaaacttttataacaaaaagtagaggttagtataactttcctctacttcttatttttaagctcatcaattatattttttaaatcatctggttttatttcaaacatatcttcttttttaaccatctttggtactaaaaggagtcctaatcttttgtttctaggttgtacaatatattctaatacttgtcctgaattattttttattttaattggtatattaaatattgtctctctagcagctttaaatatatcgccttctgactgtatattttctccattaatctcaataattttatctccacgcttaatgccaacttcatatgctggtgaatttggtgtaacctcaagaaccattatgccttcgtcatcactaacatatagacattgtccctttttttctatattagtttcatatctcataattacttcataagctaaaggtagataaataatagtaaatatctcacctaatatattaattcctgctagttgtgctattaacataatagaaataccgtaaattaaaatggctccaccacatcttaatgcttttacttttttctcttgagtaaaagtgacatttccatagcccatcattccatacaatggaatagctgctatcattgtagttgccaatattgctaatgtttcacttctattaactataggccaccatgatgatacatttaaataaaccgaatcagttgttgctgcactatttgtaaaaatcatcaatatagctattggaactggccaatatctactaaatgaaaatccaccaactattttatcatccttctttgtaaatacaggaattgctcctctatttccatctaatattattaaaattccctcaagtacatacattactccaataaaagtaactaatgataatatgttaatattcataaacaatttcattccagaaatattactaattatctttaaacaaattcctattatccctaaaattgctcctgaatacgcatatgatatatatttctttttataaaataaagataatattgatatcataaatataaattctatacctgagttttcattaaatgtaactccaagcaccgataatataatagttccaattgcacctgctaatattcctaatacaatctgggataatgttaattcaagaggggtattaatcccctctcctaatgtcatcttttggatagacacaatcctaacatttttgaaataaaatattatcccaaatattaaaatcataagtaaatgcattggctcaataattgctattgctatagactgtaaactatgaattattaaatccatcttgagcctcctaaattaattcttttcttttattacctctaaggccttttgaaattgtggatcaatgcttctatcataatcttggtctaatatatcttgtggaatttccacagtaatatctggttcaataccagtaccatgtatattttccccatttggagtgtaatactttgaagttgtaaccttaagtcctcccatttcatttggtaaaactttaagttgttgaactattcctttaccaaatgtagttgttcctattgttgtagcagcctcatgatcccttaatgcacctgtaacaacttctgatgcacttgcacttcctccatcaacaagcacaaccaatggtattcctatagcatctccacctattgagtttgatattacttttttattatatttatcaattgtataagttactacttctccttctggaataaaattagaagcaatttcaacacattcatttaagtatccacctgggtttcctcttaaatctaatattagttttttcattccttggtcttttaattcatttaatttttcactaaacttatcacttacttcttcatcgctaaaggtacttatttgaatatatcctattccatcttcaagtatttcaccttttactgattcagttttaatttcagctcttacaattgttacttcaaaaggtccttcaaccccttccctactaatagttaaagtaactggagcaccttcttcacctctaactcttgagacaactgcttctgtatttaaatctgtaacttcataatcatcaacttttaatattatatccccagctttaagtcctgcttcttctgctggtgagccctcaactggtgctattattgtaacattattatctctaactcctaactgagctcctattccatagaaactaccttggctagactccataaatgcattaaactcctcattatccatataaactgtatatggatctccaactgcttctgccattcccttcattgcaccttcaagtagcttttcatcatctaactctccatcatacatggaaaatagcatacttcttaaattgaataaatttgaatactttcctgaatcctcaatggcctctaaatcagcaactgccttttctggcacagatcctattacaatacctttagttgctaacatgttacctaagtaaaatatacctaaatacgatactccaagaaatgctatgactattaaaccttttataattttatatttctttttctttggtttaatttccccttcatttaaattctccataaatattcgttcctttctatatttaatatattatatttaccctttatttgcttaaaactacaacccataataaattaatgagttgtagtttccaaataatttcttttatatatatatttttgcctaataaatgaattctatatactatacaattaagaattttcttaatgcaaatatacttcctatagctccaactactactcctccaccaacgaagcaagctaataatgtagttaaaacgaattgtggttgtactagatttactataaacatagatgatactatccaactaaatacaccgttatatgcaaagtataatagtatacttgatactaatgatccaatcgcaccaattactatcccttcgataacaaatggccatctaataaaccagtctgttgcaccaacaaacttcataattccaacttctcttcttcttgaatatacagtaagtttaattgtattcataattaagaatacagatacacctacaaacactataaataaaccaatacctacaatttgaactatatcaacaaatttacttattgtatcaataacatcttgttgatttcctattccctcaacacctgtcatattttcaacattatttattacatcttctgcagctgctgggtcttttaagttaactataaatgaacttggtaatgggttgttatttaaatcataaccttctaatagaccttcattacttcctaaattctcttttaaatttaaaaatgcttcatcttttgattcatatgtaacttcgctaacttgctcttgctccattagttttaattctatttctttttgatcaactaattttatgtcatccttaagatatacttggatttgaattttagatgctacatcttctatacttttattaaaatttaatgctaataaagtaaacgtaccaaaaacgaaaaatgttattaacactgtaatcattgcagcaatactgattgtcctatttctttttatgcttttaaatgcatcaactataaaatagtttaacgtactaattctcattttcgtacatccccttcctatcatctcttactatcattcccttatcaatagctataactcttttttgcatattatcaactatgtcttttgcatgagtagccattaatattgtagttcctgatctatttatatcttctaataaatccattatttccttagctgtttctgggtcaaggttacctgtaggctcatcagctattaatactgatggattattaactatagctcttgctaatgataccctttgttgctctcctccagataattcattagggaacatcttatacttatgagataagccaactaaagataataccataggcactctttttctaatttccctttgtgatgcttcaacaactctcattgcaaaagcaacattttcatatacatttaaagttggtataagcctaaaatcttggaataccatacctatttttcttctataatatgggacttgtcttctagttaccttagatagttctttatctgcaactataatttctcccattgttggatctacttcttttagtaacatttttatgaatgttgatttacctgcgccagaaggcccaactaaaaaaacgaaatctcctgaattaatttttatatttacattcgataatgcttttacattgttgtcatatacctttgacacgtccttaaattcaatcataaatacacctctttatatcattaacttatatgtcttcataaactataaagccattataacatacaaacacctataataccaacatttaaggtgtatttaccttatattactatgtataaacaaaatctcttattttatttataatttcgttcctctccatataatttcaatttataatttcaatttataattttaaattttagttttagtcaactttaattattctaattatgaagtagatatattttattgatttactaattttttcaagttatagattaatttttttaacttatattattcataagctttaaaaccttctcctaaaacttctgtagaatcatttactgttaaaaatgcagctggatctatttcctttacatatttttttaatgcaataaactgatttgagtttaatactgtatatattatctttacatcgcttccagtatatccaccattcccattaagtacagtgcaccctctatcaatgtttttaattatatgattgactatttctttttcctttgatgttattatgaatacttgtttacaagtattaaatccatctataaatttatctattattaaacctattaaaataacactaaagaatccaaataatcctttatcaactccaaatacactaattgctaataaacaaacaaatgaatctgtaagtaaaacagatattcctatgccaataggtgtaaacttacttattatagctgctataatactagttcctcctgtagatgcaccttggtgaaaaactattgctgctcccatccctaaaagaattgacccaaaaacacttgctaaaaacatattttcagttaacacacctggctttaatattttttcaattatccacataaatacagataacattacagttgcataaatactttttgctccaaatgattttcctaggatagtaaatgctaatataaataataatatattaagcacaagtacaactatactagtatctaaacctaaaaccttatttacaactaaacctattccagatactccgccagcagctatatcacatggaaagaaaaaatattctagtgctatagccgttaacgccactccaattgttgttaataaatactctttaatcttttgcatacatatctcccattcttatttaattttcatctattcccataaatccttcgcccataacctcatgaacttctccaactgttataaaagcatttttatcaatttctttaattttattttttaactttacgaactcacttctatctaatacagtatataataaagcagtatcctttccagtaaagcctccaacacctttaataaatgtacaacctctttctaaatcattaagtataaacttacttatttctttatttttatcacttattatagtaatttcacttttagtcttaaatccagctattatattatctataactattccattgattattactgataataatccatataaccctatatttattccaaaagttattgctcctaataaagttactaaaaaatcaaccattaataatgattttcctatttcaatatgaaaaaacttatttaatatttttgctattatatctgtacctccagttgaagcattggcattgaacacaattgccattccacctgcagatattaatgtaccgaatatagttgctaacatcaaatcattagtaatatttattggtataaaagtttgcattacccacattgatgttgataataaaacactagaatatatagttttagcaccaaatttagctcctaaaactatcaatgcaattataaacaaaactgcatccatcattaaaactaatggtccaatagatataaatggaacataatgatttattacaattgctaatccagttatacctcctgccgctatattattaggatcaaagaaataaacaactgaaattgcaactaaaagtatcccaattgtaataagggcaaactctctaatatttttctttttcatataattactccttataaaacaaaattacttgtattattttccctcattatatatattttatcctatgcaatttaacacacatctccattatataccttatttaaccataaaaaaactgcgattttttaatcgcagttttagtggtaaatagctgtttgtggtttatctaaagactagatactgtaactaacactatcaagccctagataatgaattctaaactgagaattcactttatatttaaatctatttttttagagtaattgcttctttaactttattaactatatcttgagctgttaagttgtatgcctttaataattcatctggcttaccactttctccaaatacgtcattaactccaacctttaaaactggtactggatacttttcagtaatagcttctgctactgcagaacctaatccaccaattatactgtgctcttcagcagttacaattgctccagtttctttagcagcttcaactattaattcgctatctaaaggttttattgtatgtatatttataaccttagcattgattccttcatttgctaaaatttcttttgcttcaattgctgcatctaccataattcctgtcgcaactatagttacatccttaccttctgataaaacaacaccttttcctaatttgaattcataagtgttttcatcatttataacattaactgcagctcttcctaatcttacgtaacaaggtccattataatttgctatagctttaattgcagccatagtttcaactgcgtctgcaggtgatataactaccatgtttggtatacttctcattaatgataaatcttcaactgtttggtgagatgcaccatcttcaccaactgttaatccagcatgagtagcacaaactttaacatttaatttaggataacaaattgaatttcttatttgttcaaatgctcttcctgctgcaaacattgcaaaggtacttacaaatggaacttttccacaagtagataaccctgcagcaactcccatcatgtttccttcagcaatccccatattgaagaatctttctggacaaactgctttaaaatcagctgtcttagtagatttagataaatctgcatccaatactactacattttcattttcttttgctaattctgctaatgcttttccatatgcttctcttgtagcgattttcttactcattatctgtctcctccaatctcagctaaagctttttcacattgttccttactaggtgcagtaccatgccatgcagcttcattttccatgaatgacactcccttaccctttacagtcttacaaataactactgtaggcatacccttacaattttttgctttttctattgcatctattatttcatcataattatgtccatcaataactaaaacattccatccgaaagcttcaaatttcttatctattggtgatggattcataacattctctatattcccatctatttgtagtccattaaaatctacaaaagcagttaagttatctaatttatagtgcgcagctgccatagaagcttcccaaacttgaccttcttctaattcaccatcacctaaaatagtatatactctatatgctttattatccatcttaccagctaaagccattccaactgctgctgaaataccttgccctaaagaaccagttgacatatcaattcctggtaaacatttcatacttggatgtccttgtaatcttgaaccaaactttcttaaagtatttaattcttctactgggaaaaatcctcttcttgctaaagcactatataaaactggtgctgcatgtccctttgataatacaaatctatccctgtcaggattacttggattacttggatctatattcatttctttaaagaaaagagtcgtaactatatctgtagcagataatgatcctcctggatgtcctgatgctgattctgttaacattgaaactatatcttttctaattaatttagatactgattttaatttttctacattattaaccatttataggcctccattataacaatttatattaatattcttttattatactctatatttatgtaaattacccaaatttattttatcataaggcaaatcatttgtatacactatttttataaaaagtgtatagtatttatttaatagtatacatcatatattcatttatttatatcacttttaatatacataaatatataaaaaaactgtatcaaaatttattaataacattttgatacagtttttttataaattatttaagctagacttatactaataagtaatgatttatctacctttttcatatcagtttcagtcatatgacctattttttcttttagtctttttttatctaaggttcttatttgctctaaaagaacaacagaatccctatttagtccgtattcttctgaagaaatttcaacgtgtgttggaagtttagccttgttaatttgagaagttatagctgctacgataacagtaggactatatttattccctatatcattttgtattataataactggtctaattccaccttgctcagagcctataaccggacttaaatctgcataaaaaatatcccctctttttacaaccatagtagtcattaaaaatatcacactccgcaaagccatttctcatattcatttatatcatcatattggtatttaagtgacttttgtgatgaattactacatcctgctatctccaaattaattttcgacatttctttatatccctttttcattaattcaaagaactcacatgattcgttcttctcactatatactattaaattatctttaataaatttactacttttttcaaattcatttttaaatttgcggtttattgtattatctattttttctgacataaagttcctcctaagagttctattttctatgtataagaaaattatatttcaaataatgtcaatttgtaaatagaaacgtcactatatatcgcaaatttcgtaattttttacattttcactctttataaagcaatattgtaattatttttactaatctctatgtacttaacttgtcactataaatacaccttgatttcattaaatactgcaattggctaaatttataaatttgatttttctataatatttcatcttttgctttttagtgctatcttacttctcagcttttcgttatgtgtagtgtgaatatattacaattcagcactacacacatgcttgtccttagttaaatatctgtttattaaattctttaacttctttaaaatcatcatatattattcttaaagaatcatttccttctttatcatatactataatacctattggtgttttagttttcttattaataaagattcttgcagtgtcaaaatgttcattctctaaaaataactctgtatcaacttgaatatatattttatctccccactcttcttgtccttcttttattgaatcacttttaagtggatatgataatatcttattcataaatgccaatgaatgaagtatatccataccttcatctattacatattcattactatctgaactatcctttacatgaataccatcttctttaaatacctttactttttcatcttcaaattctattcttacaccatcttcgcttgaatagtattgaattgtatcttctcgttcttctccttttgtgttcttaactatgtactcaactttcgtttcataacatttaatatttttcaattctctaattatatcttcattgtctggtaaaaatttagctctaaagataataacaagaacaatagatataaaaggtattattaataataatgaaatgattattttctttttcataactccctccataatcactatttcattattactaatattaagtaaatgtttattttattcataatttattattaagttaaataaatatatttttttaattatgtagattgacgatcttccaaaactacaaaagcaattgccatagttttattgtgagaaatagatacattaaataaatagtttttagattttataacttcttctattttactagacacctttactactggttttcctagctcatctctaaatacttcaatatccttaaaactaaatcctcgtattcctgttcctaatgccttactaacagcttcttttacagcaaaatttccagcaatactttctactctaggcttatttttagatagccattcaacttccttcttagtaaataccttttctaaaaatcctggcgtattatctatagctctttttattctgtcaatttcaattatatctgtcccaacccctaatatcataaaacacctctttagtttaaatatattcttataatctattttatgtaaacttaaaagccaaagtcatttacacataagtcagcatactcacctactatatcaactagatgaattggcgaaactaaattgttaaataataacattaaaatttcttctgcttttctttgcttacttgctactatatcaactatatctctttctaaatttattacttctccttctttaaaatcttgtctttctatctcaataccaaaagcttgtctatttttaacgctgttttcaactatcctgtaaatatatctgctttctttgtcatcaaaattaactattttacttaaagacttctttattctcatggtatacctcacctcaacatattatttaataattaaacaatagcatacgttgcgttaaaattatgtcaaactgtggtattactactaataaaaattctcttactattcaacataaatgtaatttattacactttttttagtaattattcttacattacatatatgtctaagtaatattttcgacttaatatttgtcgaaagatattaaaaataggagttttttttctaaaaaacattatatattaactaaatcacaaaacaactctttacagcaactatattattctgtcgacaaataacaagtagcaaccttattatagtaataaggtttaaatggcaagtttcaagctaaggatttcatccttaacttgtcacttgccactctatatccttatagttttcaatgttctaatcttcgccactaacttcattattttctcttacttctcttctgtttcctacaaatttaaaatcttcagcaacaacttcagccatatatttcttattcccttgtttatcctcataactacctgtctttaatcttccacttaagcttatataactccctctagtcatatatttacaaactacttcagcctttcttccccatatagttactggaatcaaatccgcttttctagttccatctgctgatttaaaatttcgatctacagcaattataaatctagtaaaaaccttctcgccattttctatagtcttaagttcagggtctcttataagctttcctaataacactattttattcattttattacacctcctgaatatttcacctttgagtataaccacttaaagattttctattcaaataaatgtaatttttagtacataataacctactttatttttaaatttcctcttcttattccaataacagaatttatttctccaccagttataaatattatggaagttatatataaccaagtaatcaatataattactgctcctaatcctccataaatctttgaatagttactaaaattatttatataaaatgaaaagcctaaagaaactataagccatccaatggtacatatagcagcacctggaaatacctctctccattttaatctttttgatggtgtatatctatatattcctgcaaatatacaaatcataataaatattaccattccatatcttataaagttccaaattcgtgatactatttccgggaaaggtaaatatgttgttaataaatttcctattaagcgtccaaagacaagcattaccaatgtcaacataattacaaatgctaaagcaaatgtacaaattatagcaattattgcccttttaataaatgatcttgtttcctttattccatacgctttatttacccctttaataactgccctaaatgctgacgacgcagcccatactactaataataaagaagctcctaataagcctgtgttttgtttttcaattacttctataatcatactataaataagttcaaatgcactagttggcaatatagctcttagtcctcctattacctccatagaatctaaattactaaatcctattaacgttaataaaaaaattaaaaaaggaaaaaacgataatatcatataatatgctagctgtgcggctaacgcaaaaatatcatcatctctaatcttgactataaaataaataataaagtcaaaaaaatttttgcctttactgacctccgtatttgacatcgtatcaccatatttcctttctatttactcttttataaatatgtatatactcttctatatacataatgactatattttttattttaatttatactcttctaaaatccaatcagacggcaaaataaatctatatttagaattattatatctattatctatcaataaaactcttcctttatccgtttctgttctaataactcttcctgctgattgaagcaccttatttatacctggataagtatatgaataatcaaatccattggaatcaaaatactcttgtattatattattttctatagacaccttaggaaaaccaacgcctactataatagctccaattaacttatctcccggcaggtccacaccttcagaaaacatccctccaacaacagtaaaaccaaccacattattttctaaagaaaactgagctaaatactcttctttttcaccttctgacagattttctctctgcactattgtaccatttttaccatacatatcaacatatcttttatatacttttgccaaataatcaaacgatggtaaaaacaccatatagtttccttgtatttcatttataaattgattaataattttgcataatatatctatatttctctccctattaacatatctcatatctaagttatataaataagtcgataaattttttctattaaatggtgaattaaatcttactctaaaactcttctcatctccacctattaagtctacgtaatattttattggtgataatgtagctgaaaaaataacacttgaatatgcactttttaatgtttgttttaaatttgaagatggatttatacaaaatatctttattataaattcattcttttccttttttaatatagtagtgtattccttattatataattcactaaccgatataaaacttctagcactataataaaaatctaatacatcatcatatcctaaagttcctttacttttaattaaataactttcagcctcattaataaatgctcgtaataacttaattaagtctttataaacaacattatgatataataaatttttatttacctcttccaactctcttcttattaagatcatttccttgtttatagcattagatattttatataaattcggtacttttccctttataactttatttacagtcataaccttacttttttcaagttgacaactatacatatctcttgctctatttacaagattatgtgcctcatctatcaataatatattttcttcattacgatcttcaaatagtcttttaagttttactcttggatcaaatgcataattgtaatcacatattattccatcacaccaatcacttaaatctaaagataattcaaacggacaaactttatatttttttgcatactcaataatgtcttttccaaaaaacttattattatcttttattaaagatattattatatcattaatttttgtaaaataatctttagcatatatacaatcatctggattacacttaacttcatcatttaagcatattttttctttagcagtaatagttactaccttaaattcaagtccttccttatataattttaagtacgcctcctcagctacagttcttgtaatagttttagctgttaaatatattattttttcccccctagcttctccaatactctttaaagaagggaaaatagtagatatagtctttcctataccagtcggtgcttgtgcaaataaaattccttgttgttttatactactaaaacaatttacagccagctctctttgaccttttctatatgaagggaaaggaaattttaaacgttcaatacttttatacttaatcttattaaaattttctttaaccttaattacttccaaatatttattaactagataataaacaaatttttctaattcatcaaaatcatatgtcttatcaaaggatctaacttcacttgtatttatattaaagtagcttaatctaacatctatagtctttaaactattatttaagcaataaatatacccataaaactttccttgagcccaatgaagcatattgtagtcctcatcaatataacttaagtctttatatgttgattttatttcttcaataataatctttttattctcttttataattccatccgctctaccctctactaataaatttatatcattaattataaacttatactttaaggccacttctttttcataatctttgtatattgtttcattatccttttgaagtataccatgtgctattgttccttctatagctcttcctctagatacaaatctatcatctaaactaccattttttaatacatattcaataatacctcttacagattccttaaaaagtaatttatcactcataatttttccttccttattttataagtttattataacaaaaaagctaccaattaaatcggtagctttaacaataaataactatttaaggtaaatgaataattttttatcctctaatttaattttaaactctaaattaattaaatctaagatttagaatctcatttatgaatggtatccatttacaatcttttgaactaactttttaatagcactagcttgtgctattaaagataaaacaacaacaaacgttcttatactattttcatctttatcatcaagatttaagtcttttatgatagaatctaacttatcatcgtttatagcagtagcatctagatatttctcaaaactttcaccttgtgtttcaaaaaataacttataagctgtttcccaatcaataatatcatcagatctatcattgatttcattaaatgctaatctaaaaacctttttaatctcttctgttgtaagaataggtctcatataacttaataataccagttgaactaagtgaattttagtataacctctttttttaccatcttctggtttactaattacttcactttttatataattttgtactatattattagtatatttatcttctacaaacttatcatttaaaaaatctataacctgagataaaaaaaggtcatatttaggtaattcgtcataaggaatcattgatgtattagctatctcttccgcaacttcttttatatagttattatctactttattaaccatatcatttcacctcatctttctctatttttagtaattatattatatagttgttataaacttattacaagttaatatcgcctatcttatatgttatttttttattacatacctttaattttggtcatattttataaaattataccttttaataccaatttacttttttttcttattttatcgttttatatttaataattttaaattataaaatcctttttctacaaattttgtgtacaagcagtatattaaatcatttattttgtcatttattttataaaatattattgacttttcaaaaatatggtagtatagtttatttatgagttaatttaaagagaaatttgtaatcaaaactttttttaaagttttttattgacttttaattacatatctgctaatattaagctgctaaatgtcgaaacttgtttaaggaggaatttttttatgaaatcaactggagttgtaagaagagtagatgagctaggaagaatagttattccaatagaattaagaagaactttagatatcgctgaaaaagatgctttagaaatatatgtagatggtgaacaaatcatattaaagaaatatgaaccagcttgtatcttctgtggtgatgctagagatgttataaactacaaaggtaaaaacatctgcaagaactgcatggaagaattaaaacttggaaaataattttcaaatttaatttacatatttttaaccaaataattaggtggagtgctttaaatcaccccacctttattatgtctatatatctatagcaattttatatacttcttttttaggcatttctctttccttagctacaagctttattgcttcttttttatctattccactatttattaaattaatcaaatgctgttctattgttattccactaagctcttgttctttttcagctttaatttcactttcactttttcctgaaataactaaaacaaattcacctcttggtctattttctaaaaaccaattatatgcatctttaatagttcctctatatatatcttcatgtaactttgttaattctctacataccgctatatttctattccctaacgcttcttctaaataagctaatgattctattaatctatgtggtgattcataaaaaattaaagtttccttcttatcttttatttcttcttttaatatttttctttctttcgtttctctaggtataaatcctctaaatataaatttagttgtatctaatccagaatataccaatgcagtagtaattgctgtcgcccctggtaatacttcaaatgcaatattactttctatacatttcctaactacaacactgcctggatctgatattcccggtgtacctgcatcagttactatcgcaatatttttacctaactctaatttcgatattatctcatcacttttcccttgttcattatgttggtgatagctgaatagaggcttttttatattaaaatgatttaatagcttcaaagtttgtcttgtgtcttcagctgcaatttcatcaacattttctaatacttctaatgctctaagtgttatatctttcaagttacctattggtgttggtactaaatatacctttccatattccattttcattacatccttccataaatacgatttatctcttcgctataattgccattatcatcatatacatataaagtttcttcccactttaaaaatgctccaccatctctttgaccctcaactaaaactatattaggtgctttttttgtattaggttgaaccaatctaactcttttaggttctatcttatactttctcattaatccaaaaatatctgctaatctttctggtctatgtactatgaacattctcccattatccttaagaagccttcttgctgatacaattacatcttctaaattacacattatttcatgcctagcaatagctaacttatcatttggatttaaaattcctgcattatttaatttatatggtggatttactgttacaacatcaaatcttcctaatgagtctaataaagccttatcttttaaatcaccttgaacaaatttaactatatcactagtatcattaagcctagaacttctattagccatttcaaccatatcatcttgtatttctaatcctataacctcttgaggcttatattttccatatactaaaaatgatactataccagtgccagtacataaatctattactctatgtttctttttcacatttgcaaaatgtgatagcaatacagcatctaccccaaatctgaatccttgttctttttgtattaattgtagtccatttaattgtaaatcatcaatactttcatctttgcttatattaacttccataacacacctctattaaattgcttagcaatttagtttatagtttatagttaatgaataacttcagctgagctgaagttagaacaatatatattttaagaaactcccatagcagtttcatcactaactattaactcttaactaataactaactaagttgtttcgcaatatttttcaattgtaaactaagtacttttattatacatattatatataaaaaagactaggattaataaaatcctagtctgtaaattcaaattataatactcttcttgctgtatagaatttatatacgcttgaaaccttaactacatcccctgtgcttggtgcatgtatcatttgtccatttcctatatatataccaacatgtccagtatgagggaatactaaatccccaggttgaagatcattgtaagctactgctgttcccacattaatttgatcgtaagttgttcttggtaagtttactcctgcagcatttttgaatacatattgagtaaatcctgaacagtcaaatccacttggagatgttccaccccatacatatggtgttccaaggaatttatatgcataatctactatagcattaccagttgcagatactgttgagtcacctctatttggcttgcttgcggctgcattagcagcatctattgccgcttgaagttctgcaactttagcttttgcagcttcgattttttcattaacttcttcttttactatgttactcttaagttgtccatctcttatgcttcttaattgagagattgcactgtttaattgatcaattgagcttgatgaatcctctataactgcatattgtggactaactaattgtctttcagaaactgctaagaattctctttcgaattcagcttgttcaactttagcttgttcaactaaagtttcttgttcagcctttttagcctcaaattcacttagtgatttttgagtttcttcatttatttttacaagttcttcgtttttcgcatctaaactttcaatttttttgttaagagaatcttgtttgtcttcaagttctttaactatttttttgtctatgttcactaatctactagttgattcaatcttagatattaaatcattaaagctgtcggcactgaataataacattatgtagctactttgtccacctgatttatatagctctctaactctctttcctagtacttcttctgtgttagctatatcctcttttgcagtttctatttctttttcagtattttctacttcaaccttaatttgctctatttcagtattatttttctcaatagttacaactaaaggttctatttctgcatttaaactgtatatcttattgttaatatcctctatttttttcgtaaattcatcatatttgttctggttttctattacttcttgatttggtgtagcaaaggcaggcattgctgaagtaataactaaagtagcagctaataatgctgataaaattttcttcttcatatttatctgtaggtctcttgaccctccccctctcctttgttttcgttaccattataccacttatggaaactttggacaatggtaaattttaaaaacgcctatttcactgacatgtaaacatatactgccaattatttttttccaatttaatacccttttaaattatttttttataagcacaccttatatttatataaattttcacaagtattattactaatttattttcttattttcttatttaatatatattgtaatgtagatagtatagctatacatgctacaaatataattacaatagttttactaacattccctactacaaatgctgcaatagaacatgttacgcctattgctccaattaaaatattagtatacccgcttaatttcatagatttagcttctttatacagttccttatcattttcgtctatattttttatatacttattgtttaacaagaacgtacctaataaaatgaaccctaagcttcctaaaaccattactacaattgtaaaattcatctttacacccccttattggtatttactaatataaaattatatcataatattatttttaacataattctaaaacacttttcaagttttttaaataaaagtattgacataaccattaattattcatataatattaaatgtgctacggggtgtggcgcagatgggagcgcgcgtggtttgggaccatgaggtcgcaggttcgatccctgtcaccccgaccaaagagataggtttaaatctatctcttttttttgtaaataaatatattaggagatgattacttgaataatataaaagctgctatattcgatttagatggaacacttattgattctatgggcgtatggcaacaaatagatatagaatatttatctaaaaaaggacatgctgttcctaataatttaaatgatgaaatcacacatttaagttttactcaaacagctgaatatttcaaaaaaagattttctcttgaagattctattgaagaaataatgaatacttggaattcaatggcctataatctatataaaaatgatgtaaagctaaaacctggagctcttgaatatttattaaaactaaaaagcaagggaataaagatcggactagctactagtaattctatggagcttttaactgttacattaaaaagtaataatgcatttgaattatttgattccattacaatcactgatgaagttaaaaaaagcaaaagtaaccctgatatatatttacttgctgctaaaaagcttaatgttgatcctaaggaatgcatggtatttgaagatatcatagctgcagctcgtggagctaagttagctggtatgaaagttactggagtatttgatgagcattctaagcatcaagttgatatattaaaagaggaatgtgacaattacatatataattataatgatttaatttaatttaaaatgaccacacattagtgtttctttatctatttaatagataaaagactaaagtgtggtcttaatttatgttaacaatttaaatctttttatttatttaaaagcactaattaagatcttttaacttcatatttagcttcaagctctttcattacatcaacatatttcttttcttggctttgttgaattaattgttgaacaatcttatcttttacttcatcaaactcagaaacctttggctcatttttagcatctactttaattaaatgatatccaaattgagttttaactggttcacttaccttttctaactctaatgcaaaagcagcttcttcaaattcaggaaccatcatacctctaccaaatactccaagacttccaccttgtgcattagatgggcatgtagaatattctttagcagcatcttcaaaagatactccttcattttctatacgattcttaatttcattacataattcttcattatcaactaatatatgcttagcagatactgtagctggttgttcgaattgtgctttattttcttcgtaatactttttagcatcttcatcagttattgtcacatctgataatactttgtttattgtcatttgagtaagtaaatccttttctacttgagctaaactagccttatactcttcagtttcatctaatttcatttcttttcctaatttattcattaattcgaaagaaattatttgttctaataattgttttttccccatttcagaattgaacattgctctttgttcctcaggatatctcattattattgaatttaaatccttttctgtgatttctttaccagaaactacagctaatactttgttttccatatatatttctcctttttttctaattgatacttacaattataacagatttttatcaatgtatatagttacatttttttattgattatattttattgttattatataataataattattatataatattaggaggtcaaatatggtagaaattaattctgtagttcctgattttacattaatgggttctgataatcaagagcataaattaagtgaatataggggtaagaaggtagtgctttatttctatccaagagataacacacctggttgctctactgaggcctgtgactttagagataataataatacatttattaataaaaatgctattgttataggtataagcagagattctttaaaatcacatgctaaattcattgaaaaatttactcttccctttatccttttaagtgatgaaacagaacaggtatgtaatttatttaatgttattaaagaaaaaaatatgtatggaaaaaaagttatgggtattgaaagaagtacttttatcattaatgaagaaggtattcttgttaaggagtacagaaaagttaaagtaaaagaacatgtatctacaattctaaaagatttagaatcactataaaaatattaataaacaatattttattttgaagttaatagttatattcagatcagctaaattaaaaaaatgtattatttagaaactgtacatagtttcatcataaactactaactaaaaactattagcttctaactaattaaattacttttcaatttgatattattaatcaatataaaaataaaagcactaacataagttagtgctttttcctggtggctcgaccaggaatcgaaccagggacacgaggattttcagtcctctgctctaccgactgagctatcgagccacattacctggcaacgttctactctcccacacagtcacccgtgcagtaccatcgacgctgtagagcttaactttcctgttcggaatgggaaggagtgtttcctctacgccatcatcaccagattattgagattgttatctcaaaattgcacatgaattatatttttattggtcaagccctcgacctattagtatcagtcagctacatacgttaccgcacttacgtagaggaaacactccttcccattccgaacaggaaagttaagctctacagcgtcgatggtactgcacgggtgactgtgtgggagagtagaacgttgctaggtaatgtggctcgatagctcagtcggtagagcagaggactgaaaatcctcgtgtccctggttcgattcctggtcgagccaccaggtatggcgccatagccaagtggtaaggcagaggtctgcaaaacctttattccccagttcaaatctgggtggcgcctccaaaaaaacctacaagtaattcttgtaggttttttattttgtgtttttatataaatcataaaatataagtaagataaaaactattcacaatataaaataaaatatccacaactaatttaatattagttgtggatatttttaatatcttagctaaacatatcttttttatataagatgaaagcagtaaaaagtgttaaaataattgtaagaaaaataattataacgaaaccttgagggttatcctgaagtggtaatgctacattcattccaaatatgccaccaattatagttgggatagccattaatatagtaacagaagctaaaaccttcataactatattaagattattagatataacagaagcaaagaaatccatggtactagataaaatattactatagatatcagtcatttctattgcttgcttattttcaataattacatcttctagcacgtcttgatcatcttcatatttttgcatgatatccatttttaacattttttctaaggttacttcattagctttaagcgaagtagagaaataaactagtgatttttctaatgaatgtaattgaattaattctctatttttcatagatttatgcaatcttttttcaatcattacgctttttttatcaatttgtctaagataaattaaatagtaagttgaaattctatttaaaatttgaagtatgaatctagatttcttaaaagaaaagaatgatttcacacgaccatttataaaatcagttattattctgctattctttaaacatactgtaataatctctttttcagaatgaattattgctaaaggataagtatcgtaagttaaagagttatcctccatttctgtaaagggaatatctactacgactaatgtaaaatcatcctctacatctattctagaagtttcttcatcatcaagtggggctctcaaaaagcttaatggaactccagtcttttttgaaattaatattaactcttcgtcagatggggcaacaatattaatccaacaaccattttctattgaatctaattgctttaatgttgaatctgtttcgcttatacttttatatatttgaatcattaatgtacctctctattaatcatgaaatttataataagattataacataaaagaaaatttaaatctgtgattaacatttttatagtatacatttacatagtatcttataatataagaagttaaatattaatgattaatagttagtttagataagatatttcaatttatttaatacatagtggacaagatagtgatattaaagagaatatagggtttgtaattctgtatataaaattagtataatcagaatattgtcagaggaaataagatagaaatatttggaggaagtccacatatgcataaggagattaagcagggtaaaaaaacagttgcaattataatttcgttattaactattacagttgcactatatatataccaattttctaaaatgacttttgggaaaaatattaccatgaaatttatattacaggttcttttaataatggcaactctaatagttctatttatagaaactagaaagtgtaaaattgcatataagtactgtataatttctgataaacttataattaataagataaacagtaaaaatgaagagaatgtggagagcctgaaaataagagatataatttatataggtgaaaaaaataatgttcctaaaggttatagtaaatgtaaatgtagtagacattatattagaaagtttgataaggcaaaaaaattattatgtatatataaaaaagagggtaaaatatataaatttgtttttgagccaagcgatacgttagtttcacgtataaaatcttatacttaaaatagaaaagtatgaaattagaatagcaaaatgagatagtcattaaagtttaatgtggctatctcatttttttatggtttttattttaagcgtatttatagaacaagatagaatatgattaagttttcctttgaggattaaattgtaatataacaatatattagttagtatttaatttattaatagaaggttagacaatgaaaataatagaaagttttagcagagtatataatagtattgattttataaagtaatatttttaattaatactatgattattagttcctatttaaatcaaataaaatatttatataaattaggaaatagatagtatatatattaaataatgggcaagacttaataaaaaagggagggttaattttatggatattagtaataaggatatatggagagatgcaaaaaaatattgtataatatgtgagaatgaatgtattggaaatggaattcaaataatgaacaattttatttgtgataaatgtcttgaaaaaatgaatatggtagatattaatagtgatgaatatgaagtaataaaaaataagataaaaacgtctatcgcaaataaaataataaataataaataagttatatagaacttaagataatcgaaaggatgagaaggatgggtaaaggtaaattaataattattgaatcaggttcagatgcgagtggaaaggctactcaatcacaaaaattatatgaaagattaataagtgaaggaagagagtgcttaaagataactttccctgattatgtgagtgattcatcagctctagttaagatgtacttaaatggagattttggaaaagatccaaatgatgttagtccatatgtctcatcgactttttatgcagctgataggtatgcgtcttataagactaaatggggtgagttttatgagaatggtggaattattataagtgatagatatactacttcaaatatggtacatcaggctgcgaagctaaatggtgaagagaaagagaagtttattgaatggctatacgatttagaatttaatatttatcaaattccaaagccagatcatgttatattcttagatgttgatcctgaagtaagccaagagcttatgaaaaatagagctaataagtttacgggggaagaaacaaaagatattcatgaaagtaataaggaatatttgatgaattcatataaaaattctttatatattgcagaaaaatataattgggatgttgttaagtgttgtgaaaattctaaacttagaagtatagaagaaattaatgatgaagtttatgaaaaggtaaaaaaatatatataaatttaagatgggttgtttaaaataagggattgtttgaaggatagttctttgtttttaacaatcctcttatttttatcacaaattttgtattagtattaataatttaatatagataatagtagaaaatgaaaataaaaattcatataatacattatttgaggagaaaatttagtaaattcttatatatttatgataaaatatataagaagaatttattagtataaaagtggaggtatatggtatgaaactagttttagctatagtacaagatgatgacgctatagatttaattgaagagcttacagataaaaattatagggtaactaaattagcaactacgggaggttttttaaaatcagggaatactactttaatgattggggttgaagaaaaagtagtaaaggatgttgttaaagttattgaggatgtttgcaaaaaaagaaaagagatggtatctacgccaacaccaagtacaatcggcagtggatcaggaatgtatatgccttatccaattgaagtagaagttggtggggctacagtctttgttttagatgttgatcaattttataaagtttaattaagttgattaggaggtgtatgtatgagaaactttataggatatagtgatttaattaataattttaaagatagatgtttgaaaaatacactttctcatgcacacctcattgcaggagaagatggaatcggaaaaagtaaattagctaacattttggctaagcttattttaaatggagatttagagagagaatatgtggatataatcaattataagagcagtaaagcatcttttggagtagatgatgttagagatataattgaggaagtatctaagaaaccttttgaaggcaataaaaaggttataattatacatgagggaaataagcttactattcaagctcaaaatgcacttttaaaaaccatagaagaaccaccaataggagttcacataataatattatgtgagagtttagaattaattttagatacaataaaatctaggtgtgagatatataaattaacgccattaactaagaatgaattatatgaatatataaaaattaaaggctttgattataatgaaagtgatataagatcagcaatagcttttagtgaaggaattccaggaagaatagatagatattttaatgatgataacttaagggaattaagaagcaaagttgttgaaataattaagaatttaaataaaaatgatatagaaattgtactacaacaagaagaagctttaagtactttaaaggataataaagaagaagtattaaatatatttggatcttttattagggatattttaatagataaagaagttgaaaatgaggaatttatcataaatggtgataaacttgaagatataagagaacttactaaagaaatgtcatttagaaagttaaataatatgataaagacaatagaagaagcacgaaaaaatattaagagtaatgttagttgggtaatgacactacgagtaatgttaatgggcttcatggagggttagttatgataaaggtcgtaggagttagatttaagaaagctggaaagatatattattttgatccagcagatatgaatatacaaaaagatacatatgtagtagtggaaacagctagaggtattgaatttggagaatgtgtaataggaataaaagaaataaatgaaaatgatatagttgccccacttaagagtgtattaagaatagcaactgaagaggatatagataaacatttcaaaaataaagataaagaaaaagatgcatttaatatatgtttaaagaaaattcaagagcatgggttaactatgaaacttatagatgtagaatatacttttgacaataataaagttatattctatttcacagcagatggaagagttgattttagagaattagttaaggatttagcaacaatatttaaaactcgtatagagcttagacaaataggagttagagatgaagctaagatgttaggtgggcttgggccttgtggtagaccaatgtgttgttctagctttttaggagatttcgcatcagtttcaataaagatggcaaaagagcaaaacttatcacttaatccaactaaaatatctggaatttgtggaagacttatgtgttgtttaaattatgaacaaagtacttatgaagatattagaaaaagaatgcctaaagttggatcaatagtaaagacaagtgaaggtacaggagaggtattttcaaataatattgttaaagaaagtgttaaagttaagcttaaaaagggcgaagaagaaatattagaagaatttaaaattgatactattgaactaattaaaggtcattatgaggattcagttgatgacgatgatataaaattagaggtagaatctgaagaagatagaaagttaattaagaatttgattaagggtaactaaggaggagaattaatgaaagaactagttagaatttctaatttaactagtcatgcagacctcttaaaaatacgaagtatagtaagtgattacgtaggagttctagcatgtgaaattaatttaaataaaaaagaggtacatttggtatatgatagagcgagtatatctatagatgagataattaacgctattgaaacttctgggtatatggtgatttaggatataaattatattaaaattgtgtaaatttaactttacctttaaaaagaaaattatgtatgataaaataattatgttattaaaaaaggtggggaggtgtttttaatggcatacgcaattaatgattcttgtgttaactgtggagcttgcgctgcagaatgtccagttaacgctataagccaaggagatactcaattcgttattgatgcggatacttgtatcgattgtggaaactgtgcaaatgtttgtccagtaggagctccagctgaagcttaattccaatgaaaagagtcgtcatattatgatgactctttttttttatgaaaaaaataatttatatcaaaagtatgatttaaataatattataaatgataataaaatggttaagaaaattgaaaataataataagttatatttatttcaataaatctttaataaaatggctgaaaataatcaaattatagaatagacattaaaaaaaattttatatataattaaagtcaaataaggtcaaagtacgtttaggaaggtgaaattgtggcaagaatttcagatatgatagcacagtttataaatgacatgatagaagatgaaaagaataaggaggtaattattcaaagaaatgagttagcagataaatttaattgtgctccatctcaaattaattacgtattaacaactagattcacttcggaaaagggttatatgattgaaagtagaagaggtggtggcggttatataataatcaaaagaatggaatatactaataaggaaaaacaattagaggcaataaataaagctattggatatagtttaacttatagttcagctttattattattggaacatctatatgaaactaaattaataactaaaagggaacttgaaattgtaaaaatatcaattaacgatagaacattatcaaatgcagaagataaaaataagctaagagcagaaatacttaagggtattataatggttattttatcataataattatagtagatgataaaacaagtggagataaagggttgggtcatatttgcagaatataataacaagttatatttaatctatatttgattatatttggaggtgacactgtgatttttgggaggtttacagaaagagcgcaagttgtattagtggaagcacaacaagagtctcaaatttttaaacacggttatattggaacggaacatgttttattaggaatattaaaagaaaatgggtatgcaggacaacttttaactaataaaggaattactatagataaagtgaaaaagatgactgaagattatttaggatttggtgatgacgaagtttcaacaggtgaaatgctattaacaccaagagcaaagagactttttgatgatagtttagatatagcaagaaagtatggacatagttttataaatcctgagcatatattactagctttaataaatgaaggtgaaggcgttgcttttaccattttaacaagtagtaaggttgatttatcatctgttaagcaagatttagataaatatatttcagggaatgagcttagagaaagtaaaaagtcagtgcaaaaggaaaagaagcaaaataaaactcctgtattagatcaatatagtactgatttaactcaaagtgccaaagaggggaaattagatcctgtaattggtagagaagaagaaactgaaagagtattggaaatactatgtagaagaataaaaaataatccttgcttaattggtgaacctggggtaggaaaaacggctataattgaaggtttagcacaaaaaattatatctggagatgcacctgagagtttaagggataaaagattactagtgttagatataacatctatgattgcaggagcaaaatataggggtgaatttgaggaaagattaaaaaaggtaatgaatgaacttaaaaatgaaaatgatattataatctttatcgatgaaattcacaccatagtgggggctggaggagcagagggagccatagacgcctctaatattttaaaacctgcattagcaagaggagaaataaagtgtataggagcaacaacaatcgatgaatacaggaaacatatagaaaaggatgctgcgttagaaagaagatttcaaacagtcaacgttgatcctccatctaaagatgaaactgtaaatattttatttggattaagagataaatatgaatcacatcataaggttaaaattactgatggtgcattatatatggctgtagatttatcagatagatatataaatgatagatatatgccagataaagccatagatttaatagatgaagcagcagctaaagtacgaatttcaagattaactcttccaccagagattaagaaaaaagaattagatattgaaaaaataatcaatgaaaaagaagatgcaattaaaaatcaagattttgaaaaagcagcaagtttaagggataatgaaaagcaattaaaagaagagtttgaaaagattaaaaatgaatggagggcacatagttgtactgaagttcaaatagttgatgaagatgatattgcaaaagttgtttcaatatggactaaggttccagtagaaaaactaactgaaaaggaatctgataagttattgcagctagaagatattctaaggcaaagagttgtaggtcaggatgaagcgataaaagctttaactagagcggttaaaagagcaagggttggacttaagaatcctaatagaccaattggaactttcattttctgtggaccaacaggtgttggtaaaaccgaactttgcaatgttttagcagaagttatgtttggaaagataagtaacttgattagaattgatatgtctgaatatatggagaaacattcagtttcaagattaattggagctcctccaggatatgtaggatatgaagaggggggacagctatcagaggcggtaaggagaaagccttattcagttgtattattagatgagattgaaaaggcccatccagacgtatttaatatattacttcaaattatggaagatggaagattaactgatggaaagggaaaaactgtagactttagaaatactatagttattatgacatctaatgttggagctcaaaaattaaagagtcaaagaagagttgggtttgagattaattctaatttgaaagaagcagaatatgaaaagatgaaggatattgtactaggtgaattaaaaaatgcctttaagcctgaatttttaaatagggtagatgatataatagtatttaatcaattaaaggaagaagatacattacaaatagtaaatatcatgttaaaggatacaataagtagattaaaagaaaagaatattgatttagtttacgatgaggatttaaataaatttcttattaataaaaataagaatcttgaatttggggcaagacctttaagaggaataattaatagagaaatagttgataaattgagtgatgaattgcttaagggtgaaattaaagttggagataaattaaaagttgaatgtagagatgagatattagtattttctcataggtgagtgctacaaactttttaatttaggtaagataaagtaaggtgatttatttatcaccttacttttttataatattaagctatttaatattattatcattatttaaattagaattaataaccatgttttcaatgtaatttaaagtagagctatctacataatcactagataaatttttaggcttataatcatttaaaatgttttttgagggaacattattaaaataagatttatctatcaaaataccatctccttggaaattatatagatagtatttccatataataaataaatatgtatattttttatattaaaaaaaaacaaactggtatagacaactatatgtatgtataatataatggatttgggagtgatatttatgatagataaaaatagtccaataccagtatattatcaattaaaaaatgatttaataaaaaaaattgcaaatggcgtttggaagtctggagaatgtatatcaagtgaaagagaactttgtgaaatttatgaagtcagtaggatgactataagacaagctattggtgaattagttcaggaaggaatcttgattagaaaaaaaggtaaaggcacatttgtatgtgagcaaaaagtaaatcaaaaggatatgatgagctttactgaaatgattaatcaaactggaagaagattgaatacagaggttgtagagtttgaagctatagatactcctgatgatatgcaggatatttttatattagataagttatataagataacaagaaaaagaatagtagatggggaaagcatagctttagaaacagtatatattccagttgattattgtggaagtatgaataaggaaatgctatcgggatcattatataagattttggaaggttttggatatacaattactcattctaattcctcaatagttgcagttaatgttaatgatgaaataagagggttattagagtgtgaagaagatactcctatactaaagattattagcaagacatttactagttcagataagcttttatttttagaagaagcatattacaaatcagataagtttacattacaagttaatatttcaaggaaagagggagaattattatgaatttaatagttgttgataattatgaggaattaagtaaggtagcagcaaaagagtttgctaaagtaataaatgacaaaccaaatgcagttttagggctagcaactggaggttctccagttggaatgtataaagaattaattaagatgtatgaaaataaagaattagatttttctaaaattacaacagtaaatcttgatgaatacgttggattaaaccctgagcacgaacaaagttatagacagttcatgaatgaaaatttatttaaatatattaatgtagatataaaaaatacttttgtgcctaatggattagcaaaggatttagagttagaatgtaaagagtatgataaaaagattgaagaattaggtggaatagatattcagcttttaggtgtaggaaataatggacatatagcatttaatgaaccagatgaagaattatcttcaggaactcatataataacattaacggaagacactattaaagctaatgcaagattttttgataatgaagaagatgtgccaagaagagcagtaagtatgggtgtaggtggaataatgaagtcaaagaaaatagttttaattgcttcaggagaaagtaaggcagaagctattaaaggattattctcagggaagataacaacagacaatcctgcatctatgttacaaatgcatagagatgttacagtaattgtagataaagcggcagcaacacttataaataaataataattttaaaaatgaggtttttatatagcctcatttttttatatttcaagttatgttatattataataaagaaaattagaggataaaatttatatagataagaaggtgaataatatggcaaagataaaatctgtattcgtatgtgaagaatgtggatatgaatcaccgaagtggatggggaaatgtccggattgtaataattggaatacctttactgaggaacaagtagttcaacaaaataagtcagtaaaagaagcaattaaagttagggagttgtcaagaaagcctattaaaaagttatcagaagtaacttcaagtaaaagcgataggattgtaacaggaataagtgagtttgacagggtaatgggtggtggaatagttaaggattctattactataataacagcacgtccaggtgcaggaaaatcaacgctcttattacaagttgctgataatatagctagaagtggatttaaagttatatatgcttcaggtgaagaaagcgatagccaaattaagaatagggcagatagaattttaaaaaatattaatgataatatttgggtagtacaagagactagcatggataatgtagtagctgcagttaatgaaatagatccagatttgattataatagatagtattcaaacatttactatggatagctttttaccagcaagagcggggtcaccaacacaaactatggagtgtgcgaatgagttattaagaattgctaaagataataaaagacagcgtgcagtaattattgttgggcaaatgactaaggctgatgaattagcaggattaagagcattggaacacctagtagatactgtattaattatagaatgcgatacggatgaagaactaagaggattagtaagttctaaaaatagatttggaagtactggagaaacaggttttttccaaatgtctgaaaaaggaatggtatcaatagataatccatcggagttttttatgactaaaagggaagagggagaggttgtttcaggaagtactttaactgttataaaagaaggatctagacctataattacagaggtagaaagtttagtatctaaaacatttactccgtatcctacaagaattggagaaacattaggtaaggataaacttaatactttaatatctattttagagcaaaggggcggaataggactttatgataagaatgttattataaagactactggtggaatgagaataaaagaacagggaataaatttagctgttattatgagcatagtttcatctgtaaaacaaaggggaattgaagcaaatattgcttttatagctgatgtagggcttacaggcgaattgaaaaaggtaccttccatagaaattagagtaaaagaacttgcaagaatgggatttaagaaggtatatgtagctaaagattcatttaataaagaggtaaaaatacccaatataaaaataatgtctatgaaaacattaaatgatgttatagcagatgtatataaataatataattatgtaataaagtaagtatagtaagttatacttactttttttgtagaaaaaactataaagaatattatttataaatatttacaaaatcattgagttaatatttatataatagtaatattatatatgttaggaaacgaataataatgataagctaagaagtattggcttatttatataaatagagatatgaattgaaaataaaagttaggtgattgcatgagaattaaggatgataatgaaataaaaaatatattaaagatagttagtcctggaacatatttaagagaaggcttagaaaatattttgagagctaaaacaggagggttaatagttttaggagattctgatgaggtaatgcgtattgttgatggaggatttaatattaattctgaatatactccagcatatatatacgaattggctaaaatggatggagcaatagtattaagtcaagatttaagaaaaattgtttgtgctaatgcacaattattaccagatccaacagttcaaacatatgaaacaggaacaagacatagaacggcacagagaatagctaagcaaacggacacaattgttgtagcgatatctcaaagaagaaatattattactgtatataaaggtgatataaaatatgtattacaagatagtagtgtaattttagcaagagcaaatcaagcaatccaaaccctagaaaagtatgtaaatgtattagagagagtaataaataatttaaatatattagaatttcaagatttaacaacggtttttgatgttgtaactgcaatacaaagaacagaaatggtaatgagaatcgtagaagaaataaaaagatatatattagaacttggaaatgagggtagattaatttctatgcaattaaatgagttaataagatatattgaaagagatggaattcttttaataagagactattgtggagaaaatgctgatcataataacatttataaagaaattcaaaagttaaactctgaagagttagtagatttagagatcatagcaaaggtacttggatttggaggtgtttcagtagtagatacattaatatcacctaagggatatagaatattatttaaaattccaagaatacctactaatataattgaaaatttaattaagcattttaaagaattaaaatatgtaatagctgcaagtaaggaagaattagatcaagtagaaggtattggagaagctagggctacagcaatcagaagcggactaaagagaataaaagaacaaatctatttaaagaaggaactttagtaataaattaagaatattaataagacttaatggtaaaaatatataagcaggtaaaaacctgcttatatatttatctaaaggtaaatttacccagtgtattcattttgtcactttcttttagtaaaacatcataaagatttatatcaagcgcattacaaagggaagtaagataaaacaaattatttccaatttctctttctataacctcacgacagttatcacataaacaaccatcaagatgagtttttaagcagtttgataaatcttccaatgagttgtcatcgtttggcaaacattgtttttttgcatttatctcaatgcaaccacagttagttacggctttagctacagctcggttaattctacaactggattcagtatatttagttaatatatcaagaatgcttttatgccttagtagggattcactgacgtcattttgaaagctatcgaatataatgtctttcatttgcctcaactccttagaaatataattcataattaaattataagtattttcagacaattttgtcaatacaagccttatctgtattggcttaatattataataaacaacctggtcatattttgatagggggtattaaaatttaatttattctttaaagttaaaatttagtaatagtaatataaataatatggtataataaaaatggttatttataactattacttaaattaaaagtaatttaaataggaggtgagtttttgtttaagaagggattaaaaattatttttactcttttaggattagtggtaggatatatcattgcagaagctatattagcaattaatacagggcttagaattaatataataaaaggtgtagtagctactacgatattttatattttatgtgttttgcttttcggaattattttttattttatttcgccagggttatataaagtaatatctagcactatagataaaattgaaaaaaacattcaaagattaagtgcacaagagttaatttacggaagtgcaggattgttaattggattgattattgcagcatttattggagctcctttatcaggaatatttgtagggatacatcctgcaattgggccaataatatttgtattattagaacttattgcggccatattaggtgcagaaatatttataaaaaagaaggatgatatttcttcaacgttacttatatttaaaagaaataatcaaagagaaagagaaaaagagaaagataagaaaagtagaggttatgcgaagggaaatgctaaagttttagacacatctgtaattatagatggaagaatatttgatttatgtcaaactggatttatagaaggaactttagttatacctagctttgttttagatgagcttagacatatatcagattcttcagattcactaaaaagaaatagaggaagaagagggttagatatattaaataagattcaaaaggaattagaaattgaaactcaaatttgggaaggtgactttaaagatattgctgaagttgatagtaagttattgaaattagctcaaaagttaggtgggaaagtaataactaatgatttcaatttaaataaagttgcagaattccaaggagttcctgttttaaatataaatgaattggctaatgcaattaagccagtagtacttccaggtgaggaaatgaaaactatagttattaaagatggtaaagaatctactcaaggtattggatacttagatgatggaactatgattgtagttgaaggtggaaagaagtacattggagaggaaattttagttattgtaacgtctgttcttcaaacatctgctggaagaatgatttttgcaaaaccaaaagataattaaaggagaactcaaatgataagtgctattattttagctggtggtaaaggaaaacgcatgggggcacctgttagtaagcaatttattgagataaaaggaaagcctattatttattatacaataaaaaaatttagtgaaaataaaaaaataaacaatatagtagttgtattacctaaagatgaaatagattattttaaagaaaatattttagaaaaatataatttgaatatagataatatagttataggtggtacagaaagacaagattctgtatataatggccttaaaagtttagaaggtactaatacagatattgtattaatacatgatggagcaaggccttttatttctaatagaataatagatgatggaattagatttgctcaaatttatggagcatgtgcaccaggagtcatgcctaaagatacaattaaggttaaaaatgaaaaaaacttttcgattagtacaccagatagagagagtttagtatcaatacaaactcctcaagtttttaagtttaatgaaatattagaatgtcatgaaaagataaaaattaataattatattgtaacagatgatactatggtagcagagaaatgtggatatagtgtatatatttatgatggtgaatatactaatattaaagttacaactccagaagatttaattttaggtgaaaagcttatttaatttgaattccattatgttgacagagtatttttaagattatataataaattaatcaaaaaagaatattactaaagcagtgatgaagaatagtagaaatcgctaatcagagagaaaatcctttggctgtaagattttcaacagattttgaaccagcttttgagttgtaggtaaaaactatcggtttaacaccgttatcattattaaagcacaaatttaggtggtaccgcggatacaagttcgccctaattctatattagggacggactttttttatttataaacaaaaggatgcatggataaattaatgataaaagtaaggaaaggcttatttaataaaattagggggaaatttattaataggttttagtacaattatcaatttctaatgctctagtaattaagaaataaaatattagatagagaaaatcaggaggaaaataattatgaagatgtcaaatatgttagtatcaacattaagagaagtgccagcagaagctgaaatagatagtcataagcttatgcttagagctggaatgattagaaaaatggcagcaggtatatataattatatgccaattggattaaaggttttaaagaatatagaagaaatagttagagaagaaatgaatgcagctggagcgcaagaatttttagcttctgcagtattaccagcagagttatggcaagaatctggtagatgggatgtttacggagatgaaatgtttagattaaaggatagaaataacagagatttctgtcttgggccaacacatgaagaagtatttacagatatagctagaaatgaaataaagtcatataagcaattaccagtaaatctttatcaaattcaaacgaagtatagagatgaaagaagaccaagatttggtattatgagatctagagaattcataatgaaagatgcttatagttttgataaggatcaagctggattggatctatcttatgataaaatgcatgatgcatatgtaaagatttttaatagatgtggaattgatgctaaatgcgttgctgcggattcaggagcaattggaggatcaaactcagcagaatttatggttaaatcagaagttggtgaagatgatgtagtattctgtacatcttgtgattatgcagctaatatagaaaaagctgaagctacgccagaaagagcagaaattgaagaattattagagatggaaagggtagctactccagatagtagaggaatagaagaagtttcaacgttcttaaatgtgtcaccaaagaagactgttaagctattaatgtttaatgtagatggaaaaatagtaggtgtagttgttagaggagatagagaagttaatgaagtaaaagtagctaatgctgcaaaagcttcaggagatatagctatggcttctcatgaagaatatacaaaagctacaggttgtgaagttggatttggaggaccagtagggataaaggtagacttattattagtagatgaagaagtcacttacatgtataacatgatattaggagctaatgaaacaggataccacttaaagaatgttaactatggaagagactttgaaggtactgtaggagattatagaaaaattgaaacaggagaaaaatgtccagaatgtggagctgaagttactatagcaaggggaacagaagtaggtcacatatttaaattaggaactaaatattcatcagctatgaatgctacatttatagatgaaaatggtaaaaacactccatttgttatgggatgttatggtattggtgttacaagaacaatggcatcaataattgagcaacatcatgatgaaagtggaataatatggcctctttcagttgcaccataccatgtatcagttattccagtaaatattaaagatgaagctcaaatggaaatagctaataaactatatgaagatttaagaaaaattggtgtagatgctatattagatgatagaaacgaaagaccaggagttaaatttaaggattcagaacttattggaattccaatgagagttactgttggtaagaaaataactgatggtgaagttgaatttaaattaagagatggtgagatggaagtaataaaaattgatgatgttatagaaaaagtaaaatctcaatttgaaagtaataatataaaattataggatagaaaaaataaaaaaaggaggaatttcataatgaaaatatataattctttaactagaaaaaaagaagaatttgttcctatagtaccagggaagataagcatgtatgtttgtgggccaacagtatataactattttcatataggaaatggaagaacgtttattgtttttgatactataagaagatatatggaatatagggtatatgaagttaactttgttcaaaattttactgatatagatgataaaatgataaataaagctaatgaagagcatactacagtaaaagaaattggagataaatatatagcagaatattataaagatgctgatgggcttaatataaaaagagcaacaacaaatccaagagcaactgagtatatttcagagataattgaatttgtgtctggattaatagaaaaaggatatgcttatgaagttgatggagatgtttattttagaactaaaaagttcgaaagttacggacagcttataggtcaaaatcttgatgatttaagatcaggagcaagaattaatgtggatgaaagaaaagaagatcctgtagattttgctatttggaaagctcaaaagccaggtgaaccaggttgggaatgcccatggggtgttggaagaccaggatggcatattgagtgttcatgcatggccaagaaattacttggagaaactattgatatacatgctggaggaatggacttagcatttccacatcatgaaaatgagatagctcaaagcgaagctttaacaggtaagaaatttgcaaactattggatgcatgcagcattcttaaatgttaataatcaaaagatgtctaagtctttaaataatttcttaacagcaagagatgctttaaaggaatatgatgctgatgtaattagattcttaatgctttcaggacattatagaatccaattgaattttagtaatgatttattagaatcagctaaggcttcagttgaaagattatataatgcaattggaaatttagaaaatttaatttcagaagtaaaaattaatgaaatgacagaagatgaggttaagtatttaaattcattagatgcttatagacaaagatatattgaaaaaatggatgatgatttcaatacagccgatgcgatatctgtattatttgatttaataagagatatcaatagtaatgttggaataaattcatcaaaggaattatgcgaaaaagcattagaattaattagagaattaggttcgcctttaggaatactacaaaagacaactaaggggaatttagaagaagaaattgaagctttaatagctgaaagacaacaagctagaaaagatagaaatttcgctttagcagataaaataagagatgatttaaaagctaaaggtatagaacttctagatactccacaaggtgttagatggaaaaaattgattaattaatttattaaaaatataaaagaaattaaagtagagttaagagagaaggattagtgggttcctaataaattttaataaactttcatagaagtttattccttccttttaactcttagtttttaattactattgtaataaatatggttattatataattgaggagaaattaaaagatgcttaaggatttaagagtaagagaatttacggaaaaagaagcacgacttctaaatccacttcaacttgcattagtaggtgatggagtttatgaactttttattagaaaccacatattatctgaaaatattgagttaactgcccataaaatacatgttaaagcaatcggatatgttaaagctaaaagtcaagcagttattatgcataaaattgaagataaattaactgaagatgaaagttatatctataaaagaggaagaaatgctaaatcagccacagttcctaaaaatgcagatgtaagagattatagaatggcaacaggttttgaagcgttagtaggatatctatatttaataggtaatactgaaagattagagtttatattaaataatgcaatttccatagaactataagaaaaaaggagaatagttatgactaagagagagaatccaagaagaagagaaagagaatttaataaattccaagagaaaagtaataggatacaagaaaaaaataatagattccaggatagaagagaagaaaaaaaagatagaaattatgtttctggaacaagagaaacaagtagtgaagcgataagagaagatttagtaattggaagaaatgctgtaattgaagcattgaaaagtgatagaacaatagagtgtttatatataagtaaaggtgatttagaaggatcagtaaaggttgctttaggattagcaaaggataaaggcgttgtagttaaggaagctgatagaagaaaattggatgtaatgtgtgaaggattaaatcaccaaggaattattgcaaaagttactccttttaaatattgtgaagtaaatgatatattagaatatgcgaaaagaaaagatgaaaagccttttatagtaatattagatgaaattgaagacccacataacttaggatcgataataagaacggcagagctttgtggagttcacggtattattatacctaagagaagaaatgttggagtgacatctacagtttacaaatgttcagctggagcaatagagcatatgagaattgcaaaggttactaatataaatgcaactatagatattttaaaagaacaagggatttggatttatggtgcagatatagatggaaaagattatagctacaacactgatttttcaggtgcttgtgcattaataataggaagcgaagggaaaggaatttctaatttaactcttaaaaagtgtgatttattagtaaaaatccctatgataggaaaaattaactctttaaatgcttcggttgcaggtggtataatgatgtatgaggttttaaaaggtagattaactaaataatttagtgcacgtaggggtaagcagtgaaatttatatttatagatggatataatgtaataaatagttggagtaatttaaagagtgaaaaagagataagtttagatagtgctagacaaaagcttatagatattttacataattatggtgctattcatcagtgcaaaattatgttagtatttgatgggtatagagtagctggtaatttagaaaataaatatgaacacaataaaaatctaacagtagtatttactaaaagtggtgaaacagcagatgcttatattgaaagagagatacataatattggtagaagatttgaagtatcggtggttacatctgattcattggaacaacagacaattttccaaaggggtgcaactagaatttcaagtatagaattctataatatggtatttgatacatcggaagatataagaaaagcaactaaaaaagtatatacttcacataaaagtactgtacaggataatattgatgatgatattttaaaaaaattagaggctatgaggcgtgggtaaatataaaggcgctttttgggaatggagggggatttgtggataacaaagattattcgaatgagatagcaagtgaatttgaaggaatgtcagaagaagaaattgtggttgaagcaaaaaatggaaatagtagagctcaagaatatgttatttctaaatatgaaagctttgttaaggtaaaatctaaatcgtatttcctgattggggctgataaagaggatatatatcaagaaggaatgattggtttatataaagcaataagagattttaattatgaaaaatcaactacatttagagggtttgctgagttatgtataaccaggcagataattactgcaataaaaacagcaacaaggcaaaaacatattccattaaatacatatgtatctcttaataaacctgtatcagaagatgattcagaaagaacacttttggatatactatcaagtatgaagataagtgatccagaagaacttattattggaaaagaagaaaaaaggtatattgaagaagcaatttcaaaagtgctttctgatttagaaatggaagtgttacaatcttatcttgatggtaagtcttatcaagaaattgcatgtgatttagatagacatgcaaagtctatagataatgcacttcagagggtgaaaagaaagcttgaaaagtgcctttccgacactaaagaataatagtaaattaatattgacaaaaaaaacaaatgatagtaaactttataattggtatattaaagtgaatagcactttaatgctcatgtagctcagttggcagagtgtcgccttggtaaggcggaggtcgtcggttcaatcccgatcatgagctccatggagaatataaattagtatgcaaacgctaggcaaagtttatttaaaaataaggaggaatttcaaatggcaaagcaaaagttcgaaagaagtaaaccacacgtaaatatcggaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatggcaaagcaaaagttcgaaagaagtaaaccacacgtaaatatcggaacaatcggtcacgtagaccacggtaagactacattaacagctgctatcacaacagtattagcaaacagaggatacgcagaagcgttcaactatgctgatatcgatagagcaccagaagaaaaagaaagaggaatcacaatcaacactgcacacgttgagtacgaaacagaaaacagacactacgctcacgttgactgtccaggacatgctgactacgttaagaacatgatcactggtgctgcacaaatggatggagcaatcttagtttgttcagctgcagatggtccaatgcctcaaacaagagagcatatcttacttgcatcaagagtaggtgttgactatatcgtagtattcttaaacaaagcagatatggttgatgatgaagaattattagaattagttgaaatggaagttagagaattattatctgaatacaacttcccaggagatgatattccagtaattaagggatcagctttaagagcattagaaaacccaacagatccagaagcaacagcttgcatcatggaattaatggatgcagtagatagctacatcccaacaccagaaagagctacagataagcctttcttaatgccaatcgaagacgtatttacaatcacaggtagaggaactgttgcaactggaagagttgaaagaggtatcttacacgtatctgatgaagtagaaatcgttggattaatggaagaaaagagaaaagtagtagtaacaggaatagaaatgttcagaaagttactagatgaagcacaagctggagataacatcggagcattattaagaggggttcaaagaactgaaatcgaaagaggtcaagttttagctaaaactggatcagtaaacccacacagcaagttcgtaggtcaagtatacgtacttaagaaagatgaaggtggtagacatactccattcttcgatggatacagaccacaattctacttcagaacaacagacgttacaggatcaatcaaattaccagaaggaatggaaatggttatgcctggagaccacatcgatatgaacgttgagttaattactcaagtagctatggatgaaggtttaagattcgctatcagagaaggtggaagaactgtaggttcaggagttgttacttctataattgaatagtagattaattacttcatatataaagggctgggttagtttacctagtcctttaccaagctaatattattgacataatatcgcttttatgatagagtgtttaagtaattaacgaattaggtaacacaatatcatatatatacttatataattatttggataaactggaggtgcagactgtgagagtaaaagtaacattagcatgcacagagtgtaagcaaagaaattacaacacaatgaaaaataagaaaaacaacccagacagaatggaaatgaataaatattgcagattctgtaaaaaacacacacaacacaaagaaactaaatagttcgctttagagtgatgacacgtactcacaatagttaaggatgtgaagtaatggctattaaagaaaatgtaaatattaatactaaaacttctgaaaaaagagggctttctaagttttttagagaacttaaggcagaggttaaaagaataacttggccttctaaagatgacacaaaaaaagcgttaattgcagtaggcgtagtcgtactaatatatatagtattagtaggcgggttagattatatttttacaaacctctttaaattgatttttaaactataataaaggaggtttaggtgagtttctcatctatagtaaatatgagtgaaagagctagatggtatgtagtacatacatattcaggttacgaaaacaaggttaaagcaaatattgaaaagaccgtagaaaatagaaatcttgaaaatctacttcttgatatacaagttcctatggaagaagttattgaggagaaagatggtaaacaaaaggtttctttaaagaagaagtttccgggatatgtgttagtaaaaatgcttatgactgatgagtcatggtatgtggttagaaatactagaggtgtaacaggatttgttggcccaggttctaaaccagtacctcttactgatgaagaagttgaatcaatgggtgttgtagagctgcctatagatatagacttagaagtaggggaaagtgtaagagttatctcaggaccgctaagagaatttgtagcgataatccaagagataagtgttgaaaaacacaagataaaagctttaatagatatgttcggcagagaaacgttagctgaactagattttaaccaagttgagaaattagtttagtatttaaaatataaaactaatgtttttaattaagtgggaggacaaaaagtccgtattaccacagtataggaggaatattaaatggctaagaaagtaacaggaatgattaaattacaacttcctgcaggtaaggcaacaccagcaccaccagtaggtccagcattaggacaacacggtgtaaacattatgggattctgtaaggagtttaacgcaaagactgctaatcaagctggattaataataccagttgttataacagtataccaagatagatcttttagttttatcttaaagactcctccagctgcagttctaattaagaaggaattaggattagaaagcggatcaggagttcctaacagaacaaaagttggaacattaacaaaggatcaagttagaaagatcgctgaattaaaaatgccagacttaaatgctgctacaatcgaaactgcaatgagcatgatcgaaggtactgctagaagtatgggtgttacaatcgcagagtaattctgattttttaataagtgggaggtaaaaaccgctaaaaccacgaaggaggcataacaatgggaaagaaatatgttgaaagttcaaaattagttgataagaacgttttatatacaccagctgaagctttagatttagctgtaaaaactgcaaaagctaaattcgatgaaactatcgaattacacgtaagattaggggtagacccaagacacgctgaccaacaagttagaggagcagttgttcttccaaacggaactggtaaaagtgttaaagtattagtattcgctaagggagctaaagctacagaagcacaagaagctggagcagatttcgttggagctgaagaattagttcaaaagatccaaggtgaaaactggtttgactacgatgtagtagttgctactccagatatgatgggtgttgttggtagattaggtagagtattaggacctaagggattaatgccaaacccaaaatcaggaacagtaacatttgatgtagctaaagctatagctgatatcaaagcaggtaaagttgaatatagagttgataagactgctatcgttcactgcccaatcggaaaaaaatcatttggtgttgaaaagttacaagaaaacttccacgctttaatggatgcattagttaaggctaaaccagctgctgctaagggacaatacgttaaatctgtatcagtttcaagcacaatgggacctggagctaaaattaatccaacaaaagttttagattaatattgacataatgaaattaacatagtataatgaatttcgttgtgaaaaaagagaatactgtttccgtagacagtaggtgccgtaaggtttaaagtaatcgcctgcctaggataactagataagtgattatttatttggtcttcctgtgtctatgggaagacctttcttaatatatattacagttaataactgtgaggaggtggacacacagtgataaagaagaacagacaaatcaaagaagctaaagtagctgagattaaagaaaagttagaaaaagctcaaggtgtagcattagctagttaccaaggtttaacagttgaagaagatacaatgttaagaaagagcttaagagaagctggtgttgaatataaagtttacaaaaacacattagtaacattagctgctaacgaattaggtttaggtgatttagttcaatacttagaaggaccagtttcaatagctttcggttacgaagatgctactgctcctgcaagagtattaaatgattttgctaaagatcataagaagttagaattaaaagcaggtattgttgacggtattgtttacgacaaggctggagttgaaaaacttgcaacaatcccatcaaaagaagttcttattgcaaaacttcttggaagcttcaaagctccattatcaaaccttgcatacttattaaatgcaattaaagaaaaaaaagaatcagagtcagctgaataataaactgataaaaattttggaggtgcaattaaaatgacaagagaagaaatcattcaagctataaaagaaatgactgttttagaattaaacgaattagtaactgcttgcgaagaggagtttggtgttagcgctgctgctccagttgctgttgctggtggagctgttgcaggtgctgcagcagaagaaaagactgagtttgacgtagtattatcaaatgctggtgcaaacaagatcaaagttatcaaagttgttagagaaataactggattaggattaaaggaagctaaggaaatagttgacggagctcctaagacattaaaagaagctgtttctaaagaagaagctgaagacatgaaagctaaattagctgaagttggagctgaagtagaagttaagtaatttcttaacttatatataaaaaggtgctttatagcaccttttttaatgcccaaatcatgaaaatttttcaaaaattagaatgagaaatgtttttttgagaatactattatattattggagtgtaattaatatacaaaagtgttgacaaaaaaaaaagggtatgttactatcattaaatgtactattcattatggataattatatattcttgcgaaaataagtataatcaagtttaaaaatggttatactataacgtgatgctctccgaaagtatatgtccttagggaaattatgcttttggttattttactttaaacaaggggtgaaaattcatggtacatcctgtccaagtcggaaaaagaactagaatgagctttgctaaggttaaagatgtaaccgaaatgccaaacttaatcgaggtacaattagattcttatgagtggtttttaagagaaggattattagaagtttttgacgatgttaatcctatttcaaacttcactggaaatcttgtactggagtttgtagattacaaacttgatatggataatattaagtattcagtggaagagtgtaaggaaagagattgcacttatgcagctccattgaaagtgtcagtaagactgacaaacaatgaaacaggagaaataaaagaacaagaagtatttatgggagatttcccattaatgactgaacaaggtacttttataattaatggggctgaaagagttatcgtaagccaattagttagatctccaggtgtatattatagtaatactgttgataaaagtggtaaaaaattattttcatcaactgttattcctaacagaggtgcgtggttagaatacgaaacagattctaatgatgttatttatgttagaattgacaaaacaagaaaactgccaattacaatattagctagagctatgggttatggaagtgaccaagagcttttagattattttggtgaagaagaaagattcaaagcaagtattgaaaaagataatactaaaactaaagaggaagccttacttgaaatctataagagattaagaccaggtgaaccacctacagttgatagtgctgtttcattaattgattctttattcttcgatgctaaaagatatgatttatcaagagttggtagatacaaatttaataagaaattagctattaatcttagattaattaatcaaattgcagctgctgatataataaatccttcaactggagaaataatggttgaacaaggagaaaaaataagcagaacaatggcttctaatattcaatgtgcaggaattaactctgtagacattttagtagaagataaggtgttaagagtaataggtaatcactttgttgacttagaaaaagttgtgtcatttgatgtaagtgatttaaacataagagaagctgttcattatcctacattaatggaaatccttgataattatgatgatgagcaatctattaaagaagaaatcaaaaagaacataactagattaatacctaaacatattataagagatgatatatttgcaactataagttatgaattaggattagcttatggagttggatatactgatgatatagaccatttaggtaatagaagattaagatctgttggtgagttattacaaaaccaatttagaattggtttatcaagaatggaaagagtagttaaagaaagaatgactattcaagatcaagaagcaattactcctcaaatgttaataaacattagaccagtagctgctgcaataaaagaattctttggtagctctcaattatcacaattcatggatcaaactaatccattatcagaattaacacataagagaagattatcagctttaggaccaggaggtctttcaagagaaagagctgggttcgaagtaagagacgttcaccattcacattatggtagaatgtgtcctatagaaactccagaaggaccaaatataggattaatcaactcattagcaacatatgcaaaggttaatgaatatggatttatagaaactccgtatagaattgttgacaaagaaactggaatggttacaaatgaaatcagatactttactgctgatgaagaagatttatacttaattgcacaagcaaaagaaccaattggtgaagatggaagattcgtggacagtagagttactgttagacataagcatgatattttacaagttaatgctaaagacgtagatttaattgacgtttcaccaagacaaatagtttcagttgcgactgcaatgatacctttccttgaaaatgatgacgcatcaagagcacttatgggagccaacatgcaacgtcaagcagttccactattaaagcctcaagctccaatagtaggtacaggaattgagtatagagcagcagcagattcaggagtattacctaaagctaagaactcaggtacagttgtatatgttagttcatctgaaatcagagttaagagagatcttgatggaggaatagacacatataaactacttaaattcaagagaagtaacccaggtacttgtataaaccaaagacctttagtagataagggtgaaattgtatttaagaaccaagtgttagctgatggtccagcaactgacctaggagaaatcgcattaggaaagaatatcagaatgggattcattacttgggaaggttataactacgaggatgctatgcttatctctgaagaattagtaagagaagatgtatttacttctatccatattgaagaatatgaatgtgaagcgagagatactaagctaggaccagaagaaataacaagagatattcctaatgttagtgaagatgctcttaaagatatagatgaaagaggaataatcagaattggtgctgaagttagatcaggggatgttcttgtaggtaaagttacacctaagggagaaactgaattaacagccgaagagagattattaagagctatattcggagaaaaagcaagagaagttagagatacttctttaagagtaccacatggagaagctggtattatcgtagatgtaaaagtatttacaagagaaaacggtgatgacttaaatccaggtgttaacgaacttgtaagatgttatatagctcaaaagagaaagatatctgttggagataagatggccggtcgtcatggtaacaaaggggttatttctagagttttaccagaagaagatatgccattcttaccagatggtagaccactacaaatttgtttaaatccactaggggttccatctcgtatgaacatcggtcaggtattagaagttcacttaggatgggcggcaagtgcattaggatggcacattgcaacacctgtatttgatggtgcaacagaaaagaatatagaagagtgcttagaaaaagcaggatacaacgcaaacggaaagactgtattatatgatggaagaactggagaaccatttgataatgaagttacagttggtataatgtatatcttaaagcttgctcacttagttgatgataagatccatgctagatctacaggtccatattcattagttactcaacaaccacttggaggtaaagctcaatttggtggtcaaagatttggggaaatggaagtttgggcactagaagcgtatggtgcagctcatacattacaagaaatcttaacagttaagtcagatgacgttgtaggaagagttaagacttatgaagctatagttaagggtgaaaatatcccagaaccaggagttccagaatcatttaaggttcttattaaagaacttcaagctttatgcttagatgttaaagtattaaatgaagataacgaagaagttaaattaaaagaattctctgatgatgattcagaggaattagaagtaaatatcgaaggaactgaagaacttgttacagagcaagtgacaggagacgatagttacacaactaatgatgaggaaatcgacgaagatattgattatgaatcatttactttagaaggttttcatgaagaagaattagaattagatgatttcgttaatgacgaacactaaaattgaagggaggatatacccttgtttgaattgaacaattttgatgcaatacaaatcggcttagcttctccaagccaaattagagaatggtctagaggtgaagttaagaagccagaaacaattaattatagaactttaaaaccagaaagagatggtctattctgtgaaagaatatttggacctatgaaagactgggaatgtcattgtggtaaatataagagagttagatataagggaattgtttgtgacagatgtggagttgaagttacaaaagctaaagtaagaagagaaagaatggggcacattgagttagctgccccagtatctcacatttggtactttaaaggaattccttcaagaatgggattacttttagatatgtcaccaagagctttagaaaaagttctatactttgcttcatatgtagttattgaccctaaagaaacttctcttttaaagaaacaacttttaagtgaaaaagaatatagagaagctgtagataagttcggtgaagaaagcttcgtagctggaatgggtgctgaagcagttcaagaaattcttggcgaaatagacttagaaacaacttcaagagaattaaaagaagaattaaagactagtagtggtcaaaaaaaggttagaattataagaagattagaagttgtagaatcttttagaaaatcaggaaatgatccaagatggatggttataaacgtaattcctgtaattccaccagatttaagacctatggttcaattagatggaggaagatttgctacatctgacttaaatgatttatatagaagagtaatcaatagaaataacagattaaagaagcttttagatttaggagctccagatattattgttagaaatgaaaagagaatgcttcaagaagcagttgatgctctaatagataatggtagaagaggaagaccggttactggaccaggaaatagacctttaaaatcattatctgatatgttaaaaggtaagcaaggtagatttagacaaaacttacttggtaagagagttgactattctggtagatcggttatcgttgttggaccagaattaaagatgtaccaatgtggtttaccaaaagaaatggctttagaattatttaagcctttcgtaatgaaaaaattagttgaagatggagtagctcataacataaagagtgctaagagaatggttgaaagagttaacgaacaagtatgggatatacttgaagaagttattacagatcatccagttttacttaacagagcgcctactctacatagactagggattcaagccttccaaccagtattagttgaaggtagagcaataaaacttcacccattagtatgtacagcatataatgctgacttcgatggagaccaaatggcagttcacgttccattatcagttgaagctcaagctgaagctagattcttaatgcttgcagcaggtaatataatgaaaccttcagatggtaagccagtttgtgttcctacacaggatatggttttaggttcatattacttaactatggataaagaaaatgctaaaggcgaaggaatgtactttgcaaatgtagatgaagcaataatggcttataacgtaggtgaaattgctgttcatgctgcaattaatgtaagaatgcacaaagaagtggatggagtagaaaaatcaggaataattaagactactgtaggtaagcttatattcaatgaatctattcctcaagatttaggatatgttgatagaacaaatccagaaacagaatttaatcttgaagttgatttcttaattactaagaaaactttaggaaagttaatagataagtgttacattaaacacggacctactaatacatctataatgttagataaaataaaagcattaggataccattattcatctatcggtgccgtaacagttgcagcatcagatatgatagtaccggatgctaaatatgaactacttagagaagctgaagaaacagttgaaaaagtagaaaagatgtataagagaggtttcatatctgaagatgaaagatatgaaaaagttattgaaaaatggagtaagacaacagaagatgttgccaatgcgttaatggatagcttggataaatttaatccaatattcatgatggctgattcaggagccagaggatctaaggctcagattaaacaattagctggtatgagaggacttatggccgctccatcaggtaagattatcgaattaccaatcaaggcttcatttagagaaggtcttgacgtattagaatacttcatatcaacacacggtgctagaaaaggtaatgccgatacagcacttaagactgccgattcaggttacttaacaagaagacttgttgatgtatcacaagatgttatcgtaagagaagaagattgtggaactgatagaggattaatcgtagctgaaattaaagaaggtaacgaagtaatcgaaggattagcagaaagattatatggaagatatactgcagaggatatttatgatccagaaagcggtgaattattattagcaaaagatcaatatattgaatctcatatggctgatagaattacagcagcaggagttaagaaggttaaaataagatctgtatttacttgtaactgtaaagttggtgtttgtgctaaatgttatggtatgaacatggctacagctcaaaagatcaatataggagaagctgttggtataatagcagctcaatcaatcggtgagcctggtactcagcttacaatgagaacattccatactggtggggttgctactggtgcggatatcactcaaggtcttcctagagttgaagaattatttgaagctagaaaacctaaaggtcttgctatagtttctgaaattgcaggtactgtaagagtagaagaaactaagaagaagaaaactgtgtttgtaatggctgctgatggcgaagaacgtagctatgacattccgtttggttcaagattaagagtatctgataatgatgttattgaagctggagatgaaattacagaaggttcagttaaccctcatgatatcatgaatattaaaggtgttgaaggagctagaagatatttactttcagaagttcaaaaggtttatagactacaaggggttgatatcaacgataagcacttagaagtagttgttagacaaatgactagaaaagtaaaagtttctgattcaggggatacagaattattaccaggtactatgatagatatgtttgactttgaagaagaaaatgctagagtaagagaatttggtggagaagaagctaagggagaaatggctttattaggtataacaaaggcagctcttgcaactgatagtttcttatcagcagcttcattccaagaaacaacaagagtacttacagaagcagctatcaaaggaaaaatagatccattaataggattgaaagaaaatgttattattggtaagttaattccagctggtacaggtatgatgagatatagatctgtaaagcttgatgtgccaacagaagagttagcagaagataatattgatacaatagaataatacaatgcaattttattgacatgtgtatgcttaaatgataaaataccaattgtgtgatttaaagctacactacagtatgattgtctacatgatttatggaggcattctgtatagcatgcctctatgatctttaattaaggagggggattcatgttagacagaattgtagtaaaaaaggttattggaataaagcaatgtactaaattgattaaaaacaatgaaggaaaagttttatatgtagctaaggatgcaaatgctaagttgatatctccaataattcaacttgcaaaagagaaaaacattgaaattgtagaaatatctacaatgaaagaacttgggaagataggcgggattgatgttaactcatcagcaatattgaccctagaataataaattagtgtttatcttattttatatagataaataaatttcaggaggtgaagaaatgccaactataagccaattagtaagaaaaggtagaaagtctgttgctaacaaatcaacagcgccagcactaaacgagtgtccacaaagaagaggagtttgtacagttgttaaaactactactccaaagaagcctaactcagcgttaagaaagattgccagagtaagacttacaaatggattcgaagttactgcttacatcggtggtgtaggtcacaacttacaagagcacagcgttgttcttataagaggtggtagagttaaggaccttcctggtgttagataccatatcgtaagaggagcacttgactgtgctggagtagctaacagattacaaggaagatcaaaatacggtgctaagaagccaaaaacaaaatagttttctaaactaagacagtgcttatcttcggcatttacatagactagaaattttacataagtttatatagatgtaagaagcgaagcactttacggtaagtttacttaccgagtacctatgaattaaatttaaaattgttaaggagggaagaaaagtgccaagaaaaggatttatcgcaaaaagagatgtattaccagatccaatgtataactcaaaggttgttactaagttaataaacaacgtaatggaagatggtaaaaaaggagtagcacaaaagatttgctaccaagcgtttgaaattatggcgcaaaaaacaggcaaagatgctttagaagtattcgaagaagctatgaacaatgttatgcctttattagaagttaaagctagaagaataggtggtgctaactaccaagttccaatcgaagttagacctgagagaagacaaactttaggtatcagatggattttagctgcggctagaaaaagaggcgaaaaagttatggctgaaagattagctggagaattattagatgcagctaacaatactggagctgctgttaagaagagagaagatactcacaaaatggcagaagcaaacaaagcattcgctcactacagatactaatattacaagaactgttttggcttatgccaaaacagttttgtcgaatataaaattactcattgagaggaggacataaaatggctagaaaatatccattagataaattccgtaactttggaataatggctcatatagatgcgggtaaaactacaactactgagcgtatattattctatactggaaaaactcacaaaattggtgaaacacatgagggtgcttcacaaatggactggatggttcaagaacaagaaagaggtataacaattacttctgcagcaacaacttgtttctgggaaggtcatgaattaaacataatagatactccaggtcacgtagacttcacagttgaagttgaaagatcactaagagttcttgatggagctgttacagttcttgacgctaagagtggggttgaaccacaaactgaaactgtttggagacaggcagataaatatggcgtaccaagaatgatatatgtaaataaaatggatgctacaggtgctgatttcttcagatgtataaacactgtaagagatagattaaaagcaaatgcagttccaatacaaataccagtaggtgctgaagctgaatttaaaggtatgatagacttaatatctaatcatgctatcatcacttatgatgatttaggtaaagatgtaagaattgaagaaattcctgcagatttagctgatcaagctgaagaatacagaatggctatgatagaagctattgctgaaacagatgaagcattaatggaaaaatatcttgaaggtgaagagataacagaagaagaaatacatgcagctttaagaaaagctactatagctaatgaaatagttccatgtatatgtggatcttcatataagaataaaggggttcaagaaatgattaacggtgttgttgcttacttaccatcaccattagacattcctgcaatccaaggtcaaactttagaaggtgaagaagattcaagagaagcttcagataaagcgccaatggcagctttagcattcaagattgctactgacccattcgttggaaaacttgcgtttacaagaatctattctggtgttatgaacagtggttcatatgttcttaactctacaaagggtaagaaggaaagaataggaagacttgttaagatgcatgctaatacaagagaagaagttgaatcattagaagcaggtgaattaggagcagttatcggattaaagaacactacaactggtgatactttatgtgatgaaaatgcaccaattatacttgaatcaatggaattcccagaaccagttatatctgtagctatcgagccaaagacaaaagctggtcaagaaaagatgggattagctttagctaagttagctgaagaagatccaactttcaaaacttggactgaccaagaaactggtcaaacaatcatcgctggtatgggtgaattacacttagatatcattgttgatagattaactagagaattcaaggttgaatgtaacgttggagctcctcaagttgcttacaaagaaactatcagatcagctgttaaagctgaagctaaatacgctaagcaatcaggtggtaagggtcaatacggtcatgctgtaattgaaatggaaccaactgaaggtgaatacgtatttgaaaatgctatcgttgggggagctgttccaaaagaatatattcctgcaattgatgctggtattcaagaagcagctaagaacggtatcatagctggatacgaagttatcaacttcagagttaagttagtacacggttcttaccatgaagtcgattcatcagaaatggcattcaagattgctggttctatggcattcaagaacgctatgcaaaaagcaagcccagtattacttgaaccaatgatgaaggttgaagtaactgtaccagaagagtacatgggagatgttatcggtgatatcaattcaagaagaggtagaatggaaggtatggaagcagttaacggagctcaagttataagagcatacgtgccactagctgaaatgtttggatatgctacagctttaagatctagatctcaaggtagaggtaactactcaatggtattcgatcactatgaagaagtaccaaagagcattcaagaagaagttgctggtaaaagagcaaaataatttgtaataattttttgtaacattatccataatatatttatgggtagtgttacagaagttaatatatatataataatttaaatttataaaaaaacaattattgaattttaatgtaaatataaagttcacataatatggtttccataaaggaggattttcaaaatggcaaagcaaaagttcgaaagaagtaaaccacacgtaaatatcggaacaatcggtcacgtagaccacggtaagactacattaacagctgctatcacaacagtattagcaaacagaggatacgcagaagcgttcaactatgctgatatcgatagagcaccagaagaaaaagaaagaggaatcacaatcaacactgcacacgttgagtacgaaacagaaaacagacactacgctcacgttgactgtccaggacatgctgactacgttaagaacatgatcactggtgctgcacaaatggatggagcaatcttagtttgttcagctgcagatggtccaatgcctcaaacaagagagcatatcttacttgcatcaagagtaggtgttgactatatcgtagtattcttaaacaaagcagatatggttgatgatgaagaattattagaattagttgaaatggaagttagagaattattatctgaatacaacttcccaggagatgatattccagtaattaagggatcagctttaagagcattagaaaacccaacagatccagaagcaacagcttgcatcatggaattaatggatgcagtagatagctacatcccaacaccagaaagagctacagataagcctttcttaatgccaatcgaagacgtatttacaatcacaggtagaggaactgttgcaactggaagagttgaaagaggtatcttacacgtatctgatgaagtagaaatcgttggattaatggaagaaaagagaaaagtagtagtaacaggaatagaaatgttcagaaagttactagatgaagcacaagctggagataacatcggagcattattaagaggggttcaaagaactgaaatcgaaagaggtcaagttttagctaaaactggatcagtaaacccacacagcaagttcgtaggtcaagtatacgtacttaagaaagatgaaggtggtagacatactccattcttcgatggatacagaccacaattctacttcagaacaacagacgttacaggatcaatcaaattaccagaaggaatggaaatggttatgcctggagaccacatcgatatgaacgttgagttaattactcaagtagctatggatgaaggtttaagattcgctatcagagaaggtggaagaactgtaggttcaggagttgttacttctataattgaatagttttaaacttttaatttagttttaaaatctttttaaatatataattttaaattaaagcgcttataaatgtgatcacaaaaaagagaaagagtaaggggacgcctttactctttcttttttttatttctaaatatatatcaccataaaaataatttaatgcattatgtattaaataataatataagatatatatagttaagaaaaaaatatataaattaagattattaataatatgaaaagagaagaaaatataatacatattgaaaaaaagattaaaaaatagagaaaaatcctataaaaatgtttacattgatatataaaggttaatcatatataatataaggcaatacacagaaaaatttcattaattatactattgaaaaaaatttaaatacgatataaaataataacagttgaacgacagaattacttctaaaaggctaatttttttttgaataaatggttaaaaaaagatgaaaaaaagatgagaaaaaagtcttgataaagatttataaagatagtataataaagaagttgtgtagcgcaacgcgatgaatcaagaggttgccggacttccgggttattcttgaggagcaagtcaggatctagaatccgacggcaggggtagtaacttgtgttcttagttgtgaaacaccaggaacagtttacagaactacaactgttgtgcgttagaagtaaagcgtacatgaaaaggagggaaaccagaatgtcaaaacaaaaaataagaatcagattaaaggcttttgatcacactatattagatcaatctgctgaaaaaatcgttgaaacagctaaatcaacaggagcaaaggttgcaggtccagtaccactacctactgaaaaagatgttgttacaatattaagagctgttcacaagtacaaagattcaagagaacaattcgaaatcagaacacacaagagattaatcgatatcgttaatccatcacctaagactgttgatgcattaatgagattaaacttacctgctggtgtagatatcgaaataaagctataatagcttaactattaaataaacagtttgaacggttatgattgcaaagcaatccgctaatgcgtttaggaggtgtaaatacatgaaaaaagctataatcggtaaaaaaatagggatgactcaaattttcgatgaaaatggaaaggtagttcctgtaactgtagtagaagctggaccatgtgttgttgttcaaaagaagactatcgaaaaggatggttatgaagcaatacaagttggtttcggtgaaataagagaaaaattagttaataagccaagaaaaggacaatttgctaaagctggagtatctttaagaagaactttaaaagagttcagattagaagattgcagcggatacgaagtaggtcaagaaatcaaagctgatttatttgcagctggagataaaattgacgtttctggagtatctaaaggtaagggattccaaggtgttattaagagatggaatgctaacagaggaccaatgtcacacggttctaagttccacagagcagtaggttcaatgggagcttcttcagatccatcaagaacatttaagaacaagaacatgccaggacacatgggagctgtaaacacaactgtattaaacttagaagttgttaaagtaatagctgaaaagaacttaatattagttaagggtggtatcccaggtgctaacaagagcacagttgtaataagaaacgctgttaaagcttaatttctttagaaaggaggagacagaatgcctacagtaggattatttaacaaagaaggaaacaagattgaagatattcaattaaacgataatgtattcgctgttgaagtgaatgcagatgctatgcaccaagtagttgttgcattattagctaataagagacaaggaactcaatcagctaagactagagctgaggttagaggaggcggaattaagccttggagacaaaagggaactggtagagctagacaaggatcaatcagagcaccacaatggatcaagggtggagttgtattcgcaccaaagccaagagattacagaatgtcaataccaaaatcaatgagaagagttgctatgttatcagctttaactagcaaagttcaaaatgatgaaatggtagtattagacagcttaacattagaaactcctaaaacaaaggaaatagttaaaatgttaaatgctttcgatgctaaaaagacattaatcgttactgctgaagcaaacgaaacagtttacaagtcagctagaaacattgaaggagtagcagtacttccagtaaacaacatcaatgtttatgatttattaaaatactcaaaagtaatcatgactaaggatgctgtatcaaagattgaggaggtgtacgcataatgaagttaacaagccacgatataatcagaaaaccagttatcactgaaaagtcaatggctgcaatggcagaaaagaagtacactttcatagttcatatgagcgctaacaaagttcaaataaagaaagcgatcgaagaagttttcggcgttaaagttgaaaaagttcaaacaataagaactatgggaaaaactaagagaatgggcgtacatgttggtaagagagctgaccaaaagaaagctataatcacattagctcaagatagcaaaggtattgaattcttcgaaggaatgcaataatattaaagcgtagtattggtaataataccagataagcttaaagaaggagggaattagcatggcagttaaaaagtttagacctactacaccatcaagaagagaaatgacaatggctagttttgaagaaataactacaaacagcccagagaaatcacttcttgtttctttaaagaaaactggtggtagaaatgctcaaggtaaaataactgttagacaccacggtggtggagctaagagaaaatatagaataatagatttcaagagaaataaggatggtattccagcaaaagttgctacaatagaatacgatccaaacagaacagcatacattgcattagtagtatatgctgatggtgaaaagagatatattcttgcaccagtaggattaaaggttggagatacaatagtatctggagcagacgctgatatcaaagttggtaatgctaaagcattaaaagatatgccggttggtacagttgttcacaacattgaattacaagctggtaaaggtggccaaatggttagatcagcaggtacttcagctcaattaatggctaaagaaggtaactatgcaacattaagattaccatcaggcgaaatgagatatgtaagaatcgaatgtagagctacaatcggtacagtatctaacactactaacgacatcattaaccttggtaaagctggtagaaagagacacatgggatggagacctacagttagaggttctgtaatgaacccttgcgatcaccctcatggtggtggtgaaggtagatcaccaatcggtagaccaagtccagttactccatggggtaaaccagcacttggatacaagactagaaagaataagaagtattctgatagattcataataaagagaagaaatagtaagtaattgaagagaattaattctcttcaggcttactgggcctagagattatgaagggaggcaaattatagtgagtagatcaataaaaaagggacctttcgtacacgaaggacttttaaagaagatagaagaaatgaatgctaatggtgaaaataaggttgttaagacttggtcaagatcatcaacaattttcccacaaatgattggtcacacaatcgctgttcacgatggtagaaaacacgttccagtatatgtgagcgaagatatggtaggacacaaattaggagaatttgctcttactagaacatacagaggacacgattacgacgaaaaagcatcaagaaaaagaaagtaatctgggaaaggaggaacaccaatggaagctagagctatagctaaatatgtgagaatgtctccaatgaaagtaggagttgttcttgatttaataagaggaaaaaatgttaacgaggctttcgctatattacaatacactccaaaagatgctgcagttgttataaacaaagttttaaaatcagctgttgcaaatgcagagaacaatcatgacttaaatgttgaaaacttatatgttgctgaaacattcgtaggtgctggtccaactttaaagagatttagaccaatggaccacggtaaagcgttcagaatcaataagagaacaagtcatattacagtagtagttaaagaaagagcttagtaagaaggagggaaaaacaagtgggtcaaaaagtacatcctcacggacttagagttggagttatcaaaggttgggacgcaaaatggtacgctgataagagaacattcgcagacaacttaatagaagataacaaaataagagaattcgtaaagaaggaacttttctcagctggtatagctaagattgaaatcgaaagatcagctaaaagagttaagttaaatatacacactgctaaaccaggtgttgttattggtaaaggtggttcaggaatcgaagctttaaaagctaaggttactaaattagtaaacggaaagaatattttaataaatatagttgaagttaagaatgctgaagcaaacgctcaattagttgctgaaaacattgctgctcaattagaaaagagagtttctttcagaagagctatgaaacaaagcatccaaagagctatgagattaggagctaagggtgttaaaacagcttgttcaggaagattaggtggagctgaaatcgctagaactgaacaatatcatgaaggaacaattccactacaaacattaagagctgatatcgattatggatttgctgaagcagatacaacatacggtaaaatcggagttaaagtttgggtttataatggagaagttcttccaactaaaaaagttgaaaagaaggaagaagttaacgcgtaagaaaggaggaatataatcatgttaatgcctaaaagagttaagcatcgtaaggtacaacgtggtagaatgaaaggaaaagctactagaggtaatttccttgcatacggagattttggtatccaagcacaaacttgtggatggataacaagtaaccaaatagaatctgccagaatagcaattaacagatacattagaagaggaggaaaactttggataaaagtattcccagataagccagttactgaaaagccagctgaaacaagaatgggttctggtaaaggttcaccagaatattgggtagctgtagttaaacctggtagagtattattcgaattatcaggagttaacgaagaagttgcaagagaagcaatgagacttgcatcacacaaacttcctgtaaagtgtaaattcgttacaagaagagattttgaggaaatgggtggtgaagaataatgaaggctagagaattaaaagatttaagagcaaataatcctcaagatttagttgctaaattaggagaattaaaagctgaattattcaacttaagattccaattagctacaggacaattagaaaatcctatgagaataagagaagtaaagaaatctatagcccaaatcaaaaccatcattagagaagaagagatcagggcatttgaacagtaaatctggaaggaggtagcccctaatggaaagaggattaagaaagaagaaaatcggtagagttgtttctgataaaatggataaaactatcgtagttgctgttgaaactaaggtaagacatccactatacggaaaaactatgaatagaactactaaattcaaagctcatgatgaaaataatgaagctaacatgaatgatagagtattaataatggaaactagaccattatctaaagataagagatggagacttgttgaaatagttgaaagagctaaataagcttttaaagactgaaaggagggtaaatttcaatgatacaacaacaaaccttattaaaggtagcagataactcaggtgctaaagaaataatgtgtatcagagttttaggcggatcaaagagaaagttcggtaacattggagatataatagtagctagcgttaaaagtgcaacaccaggcggagttgttaaaaaaggtgacgttgtaaaagctgttattgttagatcagtaagaggattaagaagagctgacggttcatacatcaaatttgatgagaacgctgctgttataataaaagatgataagcaaccaagaggaactcgtatcttcggaccagttgctagggagctaagagataaagaatttaacaaaatattatcattagcaccagaagttctataatagaggaggtggctaatttgaagttacacgttaaaaagaacgacacagtagtagttatttctggtaaagatgctgggaaaactggtgaagttttaaaagtatatccaaaaacaggaaaggttcttgttcaaggagttaacatagtaaagaaacatcaaaaaccatctagagctaatgctcaaggcggaataattgaaaaagaaggagctatctacagctcaaaagttatgttatactgcacaaaatgcaaaaatgctacaagaattagcagtaaaatcttagaagatggtactaaggttagagtttgtaagaagtgtggagaaacattctaagatctgaaaggaggtactaattatgacaccaagacttcaagagaagtatacaaatgaagtaattcaagcgatgacagaaaagttcggatacaaaaacgttatggaagttccaaagcttgaaaaaatcgttataaatatgggagttggagaagctaaagataaccaaaaggttttagaatctgcggttgctgatttacaacttatctcaggacaaaagccaatcttaacaagagcaaagaaatctgttgctaactttaagattagagaaaacatggcattaggatgtaaagttacattaagaggagcaaagatgtttgaatttgctgataagctaatgtcaattgctcttccaagagttagagactttagaggggtttctgacaaagcatttgacggaagaggaaattattctttaggaattaaagaacaattaatattcccagaagtagaatacgataagatcgataaggttagaggaatggatattatcttcgttacaactgcaaagactgacgaagaagcaagagaattattaagattccttggtatgccattcgctcaataataaggagggaaaactgtggcacgtaaagctattattgaaaagtggagcaaagctcctaaatataaaacaagagcttatacaagatgcagaatatgtggaagaccacatgcagtattaagaaagtttggtatttgccgtatatgctttagagaacttgcttacaagggtgaaattcctggttgtaagaaggcaagctggtaaacctaacgactgaaaggaggcaaattaaatggttatgacagatcctatcgcagatttactaactcgtattagaaatgcgaatgctgtaagacacgaagtagtagaagttccttcttcaaacgtaaagaaggctgttgcaaatatattattacaagagggatacatcaaaaatattgaagaatataatgacggtgtagttccaatgatgagattatctcttaaatacggttctaacaaagaaagagttataactggaatcaagagaatttcaaaaccaggtttaagagtatactgtaagaaggatgaagttccaagagttcttaatggattaggaatcgctgtaatttcaacttcaaaaggtatagttgtagacagagaagctagaaaattaggcttaggtggagaagttgtttgctacgtttggtagtaacaaatttgaaattaagtagattaacatatagatctaagaagtaatacaggaggtgcgattatgtcaagagtaggtagattaccaatagctatccctgctggagttacagttacagttactgaagataacgttgttactgtaaaaggaccaaaagggcaattagttaaggctatggacaaagacatgaatatagcagttgaagacaaccaagttgttgttacaagacctagtgatgttaaagagcatagagctcttcacggattaactagagcattaatcaacaacatgatcataggagttgaaaagggataccaaaagactctagaattaatcggtgttggttatagagctcaattacaaggaaagaaacttgtaatgaacttaggatattcacacccagttgaaatagaaccagctgaaggaattactttcgaaactccagcagctacaaaagtagttgtttcaggaatcgataagcaattagttggtgctgctgcggctgatataagaaagtggagaaaacctgaaccatataagggtaaaggaattaaattcgaaggcgaagttatcagacgtaaagaaggtaagactggtaagaaataattaggaaggagtgaaccttatgttcaagaaggcagacaaaaaagcaagcagagcaaagcgtcaccttagagtacgtaagaaagtttctggtactcctgaaagaccaagactttcagtttatagaagtgaaaaaaacatatatgctcaaattatagatgatataaatgctgtaactttagtatctgcttcaactttagataaagaagttgatgttaaggtaggcggaaacaaagaagctgctaaattagttggtgaattagttgctaaaagagctttagataaaggtataactgaagttgtattcgacagaggtggatacgtatatcacggaagagttcaaacattagcagaaagcgctagagaagcaggcttaaaattctaatcaaacaaggagggaaatcaatgagaatcgatcctagcacactagaccttaaggaaaaggttgtttttataaacagagttactaaggttgttaagggtggtagaaacttcagattcagcgctttagttgttgttggtgacgagaacggacacgtaggcgtaggaatgggtaagtcaatcgaaatcccagaagcaattaaaaaaggaatcgaagacgctaagaaaaacatggttagcgttgctatagttggaacaacagttcctcacgaaatatatggtaagtttggaactggtaaagttttaatcatgccagctaaagaaggtacaggagttattgctggtggaccagcaagagctgtattagaattagcaggattaaaggacgttagagctaagtctttaggttcaaacaatccaagaaacatggtaaatgctacaattaatggtttagcaaacttaagaacagctgaagatatagctagattaagaggcaaaactgtagaagaaatattaggttaggaggtatacgcaatggcaaagataaaggttactttagttaaaagcttaataggcagaaagaaagaccatatcgctactgcaaatgctcttggtctaagaaagattaacaaaactgtagagcatgaggatactcctcaaatcagaggtatgatcaacaaagttgactacttattaaaagtagaagaagtataataaagaggaggtgcacgagatatgaaacttcatgaattaaaaccagcagctggtagtaaaaaagctcctaagagagttggtagaggtactggttcaggtttaggaagaaacgctggtaaaggtgaaaaaggacaaaacgctagatcaggcggtggagttagaccaggatttgaaggtggtcaaatgccattatacagaagacttcctaagagaggattcactaatatcttcgctaagcaaatagtttctatcaatgttgatagattaaacatatttgaaaacggcacagtagtaactccagaattattacttgaaacaagagtaatatctaaagttaaagatggagttaagatattaggaaacggaacactagaaaagagcttaactgttcaaggatgtaagatgtctaaggcagcagctgaaaagatagaagcagctggaggaaaagttgaggtgatgtaatatgctatcaaccctacgtaatgcctggaaggttccggaacttagaaaaagatttttatggacgatatttttagtagcaattttcaggattggaatacatattcccgttcctggaattgatactagttatttaagctcaatgacaaactctggtgggttacttggtttttataatttaatatcaggaggagctttaagcaagtttagtatatttgcattaagcgtttcaccttatattaatgcatcaatcataatgcaattattaacaattgcaattccttcattagaacaactatctaaagaaggagaagaaggtagaaaaaaaattcaatctattacaagatatgcttcaatagctataggttttgtattagcaattggaatttactcaatgattgcagcacaaggtgcagcaacaggattaaatacagctcaaaaggcaatagtattaatttcattggtagtaggatctactttctgtatgtggcttggtgatcaaataactcaaaaaggatttggaaatggagtttcaatattaatatttgtcaatatagtatctcaattacctacaactttaatgtcattatttacattaaaagaagcaggtgaaattactattattgaaatagcattattcttagttggtgctttagcactattagtatttacaatttacttctcgttagcagagagaagagtgccaatccagtatgctggtaaggctgtaggttctaaggttatgaaaggtcaatctactcatataccactaagtttaattggatcagcagttattgcaattatttttgcaatgtctgtaatgatgttccctgaaacaatagctaatttcttcccaactaagggatggtcacaatggatattaaacagtccatatagtatttttaataaaagtacatggatgtatccagtttgttatgcagtattaacagtattctttacttggttctatactcaaataacatttaaaccagatgaaatggctgagaatcttcataagtctgcaggctttgtaccaggagtaagaccaggtgaagctacagagaagtatttcgaaaaagtacttactaaagtatctttaatcgggggattatttgcagcattattagctgttactccaatattaattagtaattatacagatttaagtggaatccaatttggtggaacgtcactattaatactaattggagttggtttagatttttctagacagttagactcacaattagttatgagacactaccaaggattcttaaaatagatttataatggagatgatgcccgtgaagatagtattattaggtcctcctggggctggaaaaggaacacaggcaaaatcaattagtaatagatactctataccacatatttctactggggatatctttagaaagaatatttcggaagaaacccctttaggaatagaagcaaagcaatatattgataatggtcaattagtaccagatgaagtaactattaatatggttaaggatagacttacatgggaagactgtaaaaatggttatctattagatggtttcccaagaactgttgctcaagctgaagctctacaagagtttttagaatcaagagatgaaaacttagatacagctttatgtatcgaagtacctagcagtttcatacttgaaagaatgacaggaagaagagtttgtttatcatgtggagctagttaccatataaaattcaatccaccaactgttgatggggtttgcgatgtttgtggagacaatgttatccaaagaaaagatgatgttgaggaaactgtaaaagagagattagatgtctatgaaagacaaacacaaccactgattgatttttataaagagaaaaacttactttctactgtagatggaactaaagctattaatgaagtattcgaaagtatctgcgatatattagggagtgcaaactaatgattattatcaaaaatgataaagaaatcgacctaatgaggattgctggtagaatcgtagctgaaactcttctattagttgaaaaagaggttaaaccaggaataactactgctgagttagataggatagcagaagaatttataactaagcatggggcgacaccttcatttaaagggctctatggatttcctgcttcactatgtatatctgttaatgagcaagtagttcatggaataccaggagggtatgtattaaaagagggagatattattagtgttgactgtggtgcacatattaatgggttccatggagatgcagcaagaacttttgctgtaggtaatatttcggatgaagcaaaaaaacttattaaagttactgaagaatccttttttaagggtttggaatttgctaaaataggaaatagactaactgatatttcacatgaaatacaacgctacgttgaggcttcaggtttctctgttgtaagagaatttgtaggtcacggaataggaaagagtgtccatgaggatccagaagttcctaacttcggaagaccaggccgaggtccaaaattagttgctggtatggctctagctatagaacctatggttaatatgggaacatatagagtagctactttaggtgatgattggacagtagtctcagcagataagagcctttcggctcactatgaaaacactgttgtaattttaccagatggaccagagatattaacactgatcaaataagtgttgcttagttataaattcgcatgataccaaaaggtggcttgtagatttatggctaaggtaatcatcgaggtgaaagtgatttgcaaaacaatgacttaattgggaaaattgttctttcaaaatgcggaagagataagaatcattattacgttattgttgataaagttgatgatacttattaccttcttagtaatggaagtaataagacaattcagatgcctaagaaaaaaagcataaaacattttagtgttttagagaatgtagatgatgagattaaagcatcaattatattaaagaaaaaaggtactgatttaaaaattaagagatttctaaaactaaaaggcattgttaaggagggttgattaccttatgtcaaaagatgatgtaatagaaatgcaaggtgtagtcttagaggctttaccaaatgcaatgtttcaagttgagttagaaagtggtcataaaattttagctcacatatcaggaaaattaagaatgaacttcataagaattcttccaggagataaggttactatagaactttctccatatgacctaacaagaggaagaattacttggagagcaaaataaggtaaatatatttaccataaattacacaaggagggttagcgatgaaagtaagaccatcagttaagcctatttgcgaaaagtgcaagattattagaagaaaaggaaaagtaatggtaatctgtgaaaatcctaagcacaagcaaaaacaaggctaatatgatttaatattaggcagaataatttacaattattaatatattgacttttatttgaaagttcaatattattatataggcgtttaaatcagcttattgattttaggtacggctgacgataggttaatttaacctatcgacctaagattttaatataaatttaccaaaagcaaaaataaaaaattgcatttcaataaacaggaggtgtaagttcaaatggcaagaatagcaggcgttgacctaccaaaggaaaaaagagttgaaataggtctaacatatatatacggagttggtttatctacttctcacaagatattagctactactggaatcaatccagatactagaattaaggatcttactgaggatgaagtaaatgaaatcagaaactatgtaaacaagaacttaatggttgaaggtgacttaagaagagatgttgctttaaatattaagagattagttgaaataggttgttacagaggtattagacatagaaaaggtcttccagttagaggacaaaaaactaagactaacgctagaactagaaaaggtcctaagaagactatcgcaaataagaagaagtagtgaggagggatttcgatggctcaaaaagtcaaaaagactactagaagaagaaaagaaagaaagaatgttgagcatggtgctgcacacatccaatcaactttcaataactcaatagttactttaactgatgcggctggaaatgctttatcatggtcaagtgctggagctctaggtttcagaggttcaagaaagagcacaccatttgcatctcaaatggcagcagaaacagcagctaaagcagctatggaacacggtttaaagagtatagaagtatacgtaaaaggaccaggagctggtagagaagcagctataagatcattacaagctgcaggattagaagtaactttaattaaagatgttactccaattccacacaacggatgtagaccaccgaagagaagaagagtctaattatatttaaattcaacaggaggtgtaacgaatggcaagatatactggagctacatgtagattatgtagaagagaaggtcaaaagctattccttaagggagatagatgttatacagataaatgtgctttcgtaagaagaagctatgcaccaggacaacatggagcagctaagaagaagttatctaactacggagtacaattaagagaaaagcaaaaagctagaagaatatacggtgttttagaaggtcaattcagacattactatgaaaaggctgaccacatgaagggaatcactggtgaaaacttattaatgttactagaaatgagattagataacgttgtttatagattaggatacggtgcttctagaaacgaagctagacaattagttactcacggacatttcttagtaaatggtaagaaagttgatattccatcatacagagtatcagttaacgatgtagtatctgtttgcgaaaagagcagaggaactgaaaagttcaagactttcgctgaaaatccaaagacattaccaaaatggttagaagctaacgttgaaaactatgaaggtaaagttgttgctgcgccagctagagaagatattgacgtaccagttaatgaaactctaattgtcgaattatacagcaaataatagtttaatatagtttatattaatatattattttagattatttaatggaatcagttgccctcgtaaaaaggttgccattttatatataaggagggtttatacatgttagaaatagaaaagccaataattgaatgtatagagtcaaatgaagatggtacatatggtaaatatgtagttgaaccattagaaagaggatatggtattacacttggaaatgcaatgagaagaattcttttatcttctcttccaggtgtagctactacatcaattaagattgatggagtacttcatgaattctctactgtacaaggtgttaaagaggatgttactgaattaattcttaacatcaaatctttagcattaacaatggaaggcgaaggtccacaaactatctatatagatgctaaaggaccaggagttgttacaggtgcagatattaagactgatggaagtgttgaagtaatcaataaagatttacacatcgctactcttgatgaaaatggaagactgtacatggaattaacagttaacagaggtagaggatacgttactcaaaataaaaataagagtgattcactaccactttcatcaatagctattgactctatttatactcctgttaagagagtaaactttacagttgataatactagagttggtcaaatcactgattatgataaattaacactagaaatttggactaatggtactattaaaatagatgaagctataagcttatctgctaagattttaatagagcactttaagttatttatgtcattaggtgttgcaactaatgatgttgaaataatgattgaaaaagaagaagataaaaaagaaaaagtactagaaatgactgttgaagaactagatctttcagttagatcttataactgcttaaaaagagctggtatcaatacagtacaagaacttgctggtaaatcaatggacgacatgatgaaggtaagaaatctaggaaagaaatctttagaagaagttgaaagaaagcttaaggaattaggtttagccttaaaactaagcgacgagtagggaggtaaatccatggcaggttatcgtaagttaggtctttctacagaccaaagaagagctatgttaagaagtcttgttactagcttcttaaagcatggtagaattgaaactactgaaactagagctaaagaagctagatctatagctgaaaagatgattactcttgcaaaaagaggagatcttcacgctagaagacaagttttagcttacgttttagaagaagatgttgttaaaacattatttgatgaaatcgctccaaagtacgctgaaagaaacggcggatacactagaatgatcaaaaaaggtcctagaagaggagacggagctgaagttgttatacttgaattagtataatttcactctggggattaagttttacttaatccccattttttcatataaaaaagtattaattaaatatgtcaattttatcataagataatagagagattatatatcaaatacttgtaattaaatagagcttctatataattaaattatggaaatttatatgaaatttatataatttaattatataaaaaggtgtttctaaaggagggatacatatggagaaaatgatagaatgtaaaaatgtagtttttaaatattctacaggtgaagaaggaatagaaaaattagctatagatggattgaatttagatgtaaataaaggtgaatttttagttgttttaggacataatggatcaggaaaatccactgttgcaaaacatatgaatgccttattagtacctactgaaggaactgttatcgtaaatggattagatacaactgatgaaaataatgtatgggatattagatcaagtgcaggaatggtattccaaaatcctgataatcagttagtagcaactattgttgaagaagatgttgctttcggacctgaaaacttaggagttccaccacaagaaataagacaaagagttgatgaagctcttgaaaaggttggaatgagtgaatataaaaggcatgctccacatttattatcagggggacaaaagcaaagaattgcaattgctggtatattagcaatgcaaccgaagtgtattatttttgatgaacctactgcaatgcttgatccagcaggtagaaaagaagtaatgaataatattaaagatttaaataagaaacatggaatcactgttatattaattactcactacatggatgaagctgctcaagcagatagagtagttgtaatggataaagggaaagtaataattgaaggaattccacgtgatgttttttcagaggtagaaactatgaaaaaaataggattagatgttccacaagtaacagaaatatgctatgaattacaaaaagcaggaataaatattgatactaaaattttaaatgtgaatgagatggtgagtgcgttatgtcaattaaaatagaaaatttaacacatgtatatatgcctaaaactccatttgaaaaaaaggcattagataatgttaatttaacaatagaagatggagaatttttagctttaataggtcataccggttcaggtaaatctacacttattcaacacttaaatggattattagagcctagctcagggagaattttagttgatgaagttgacataactagcaaagaagttaaacttagtaatattagaaagaagataggattagtatttcaatatccagaatatcagttatttgaagaaactattgagaaagatgtagcatttggaccaaataacttggggttatcgtcagaagaggtttctagtagagttaaaaaatcaatggaaatggttggtcttgattatgaaacttataaggatgtttcaccattcgatttaagtggaggtcaaaaaagaagggttgcaatagcaggtgttatagcaatggaacctaaagtattaattctagatgaaccaactgctgggttagatcctaagggtagagatgatattttagagcaaataaagatacttcatgaaaaatataaaatgacaattgttttagttagtcatagcatggaagatgtaggaaaacttgctgaaagaatcgtagttatgaatggtggaaagattgagttattaggaaaaccttcagaaatatttaaagaagtagaaatacttgaaagaatagggcttgcagttccacaagttacttatttaatgagagcattaagagaaaaaggttttgatgtttctgatgaagtgtttacagttgaaaaaggaactgtagaaattttaaaagctttagcaaatagaagaaagagagaagtttaatatgattaaagatataactataggtcagtatataccaggtgaatctttcatacataaactagatcctagaactaagatattaatagcatttttattcataattagcctatttattgtagataaatttgttggatatatttttgttgttgctttcttagcattggttgtttatgtagctaaaatatctccaagatatctgtataagggattaaaaccggtatttttattaatagcattaactgcaattttaaatatatttatgcttagagatggaagattactttttgagcttggatttataaaaatttatgaatcaggtattaagactgcattctttatggcaataagattgatacttcttattatggggacatctgttttaacattaactacatctccaatagaattaacagatggaatagaaagattactaagaccaataggtaaagaaatggcccatgaattagctatgatgatgactattgcattaagatttatacctacccttattgatgaaactgataaaatcatgaaagctcaaaaagctagaggtgctgactttgaaagtggtggattaattcagaaggctaagagcttaattccacttttagtaccgttatttattagttcatttagaagagcagatgaacttgctatggctatggaagcaaggtgttatagagggggagcaggaagaactagaatgaaagttctaaagtttacttctaaagattttattgcatttggtgtatttgctttattattagctagtacacttattgttagatttgcaatgtaataaatttaattgaaaaggtgatatgttgaataatattaaattgaccttagaatatgatggaacaaattattatggatggcaaaagcaaaaggagcttaagacaatacaaggcgagattgaagaggctatagagattgttactaaagaatattccgaagtaacaggaagctcgagaacagatgctggagtccatgcaaaaggatttgttgctaattttaaaactaatagtaaagtgcctcctgctaagtttagagaggcactaaacgttaaattacctgaggatatagtaataataaaatcagaacaggtagaagatgattttcatgcaagatattgtgcaaagggtaagacatatgagtattatatattaaattcggaagtaccttctgcattaatgagaaatcaaatgtatcattataaatatgatcttgatgtggatgctatgaaaattgcggcaaagcaatttattggtacacatgattttgctgcctttaagacacaaggaagttctgtaaaaggtacggttagaactatttttgatgttaaagtagaaaaagaagagaatgttataaaaatttctgtaagtggtgatggttttttatataatatggttagaataatagttgggactctaataaacgttggtaggggaaaaacagatgctgtgtcaatatcatatataataaaccaaaaagatagaaccttagcaggagattgcgtgcctcctcatggactatttttaaaagaggtttattattaaaaaatatttacaaaaaatattgacacacccgcatccgtgtattataatttattttgtttgttagaataatttatgtacgtaaggccacgagccccgaggtcttgacataaatgttatacataattaagtataacgataaaatgtaagttcagggagggaaaacacatgaaatcatacattgcaaaagcacaagaagttgaaagaaaatggtatgttgttgacgctgctggtaagccactaggaagagtagctagccaagttgcttcaatattaagaggaaagaataagccaacatttacaccaaatgttgattgcggagatttcgttatagttatcaatgcagaaaaagttgttttaactggtaagaagttagatcaaaaaatgttaagaaagcacagcggatacgttggtggattaaaagaaattccttacagagaagttcttgctaagaagccagaatttgctttcgaagaagctgttagaagaatgcttccatcaggagtattaggtagaaaaatgcttaaaaagttaaaagtatacaaaggtactgagcacgaacacgcagctcaacaaccagaagtacttgaattaaagtactaatacaagttcgggaggaggaataaaaaatggcaaaagttcaatacatgggtactggaagaagaaaaaaatcagttgcaagagttagacttgtaccaggaaatggtaaagttactatcaacaatagagaaatcgaaactttctttggtttagaaactttaagaatgatcgttaaccaaccattagttttaacaggaactaaggataaatttgacgttttagttaacgttcacggtggtggattcacaggtcaagctggagctatcagacacggaattacaagagctttaattaaatcagatgaaaacttaaaatctgaattaaagaaagctggtttcgtaactagagactcaagaatgaaagaaagaaagaaatacggtcttaagaaggcaagaaaagcatctcaattctcaaagagatagtattttttcagggaggttttatacctctctttttttttataatgatattattataaaaatatagcagtaaatattgttataaattaagtaataactaaattgtaaagataatgttagataagaattaaaaaataaatgaagagctggataaggttaagtaattatagctgatattaaataatcactatgattgcttttttattttaattaaatagaattcactaaaaaatatagcaatgaaatagatatcataaactttttactaagatatatactgaaaaaatagttaacataagattgtaaaaaataatattaaatctatgttaaaaaatgttgaaatctattaacaaatgttaaattttattgtaaacttaacgaggtgaaacttttattaatatacataaaatatacaagagtgaaggagaaattatcttggatacgatattaactattgttaaattattaggtggattaggactattcatctacggtatgaagttaatgggtgatggtcttgaaaatgctgctggtgaaggattaaaaaagatacttgaaaaagtaactaaaaatcctataattggagttattgtcggagctgtagtaactatggttattcaaagtagtagtgctacaactgttatggtagttggatttgttaatgctggattaatgaatttagcacaagcggctggaattataatgggggcaaacattggaacaactgttacagcacagttagttgcttttaaattagataatattgcaccaatttttgtttttgttggtgctatgatggtaatgtttgttaagggcaaaaagagaagagaaattggtaacataatacttgggtttggtattttatttgttggtatgggaacaatgagtggggcaatgaaaccacttacatcatctccaatgttccaagaaatacttacaacagtaggagcacactggtatttaggtgtaatagcaggggcgttaattacagcagtacttcaaagttcatctgcgactacagggatacttgtagctttagcgacagcaggagcattaaatattaatcaagcacttccaataataatgggatgtaatattggtacttgtataacagcaatgcttgcaactgttggtactaataaaactgctcatagagctgctatgttacatttaatattcaatgtagttggtactataatattcttaccaataatagtgccaggattcttaggtaactttgtttcgtattttactacagatgtaaatagacaaattgcaaatgcacatacaatatttaatgtagtaaatactttaataatggttcctttaatacctatattgtgtaaaatagttgagagaatcataccaggtgaagatgacgaaaaagtaggacctaagtatatagatgatagattattagaaactccagtaattgcagctgggcaagttgttaaggaaactataagaatgtctaataaggcaaaattaagcttagaattagctatggatgcatttatgaaaaatgatgaaagcttagctgaaaaagtatatgaaaatgaagagataattaacaaccttgaagaatgcataacaaattatttagttaagctttctaagtgtgaattatctgataaagaaaagaacatagttgcatctacattccacatagttaatgatattgaaagaataggagatcatgcagagaacttagctgatttaactattcaaaagattaataaaaaattaagctatagtaatgaagctattggtgaaataacaaatatgtatcaaagcactttaaaggcattagatatatcaatagaaagttattctgatagagattcagcaaaagcaaaagaaataacaaatgttgaagctgaaatagataagatgcataagagatatagagacctacatattaagagattacatgaaggtacttgtaatgcatatgctggtgcaatattccttgatttattaagtaatttagagagaataggtgaccattcaacaaatattgcagaaatagtaattgaaaataataattaagaaagagcgagaaatcgctctttttttattttgaataaatagttataaaattaaacaaaataaaaatgatattaatataatggaggatgtgttatgaaaaaaattattgttgctatttttacttgcttaatacttattaattttattaatatagcttatgcaatggcagaagatgatgaatcaaaaaaggtaattttaattgatccagggcatggaggaattgatggtggtgcaaaatcacaatcaggaacaatagaaaaggatataaatttacaaatagcattaaagcttagagataatttagaggataaaggatataaggtttgtatgactagggagagtgatgaaggtctttatcaagaaggtaaaactgtaaaagagaaaaagagagaagatttaaaaaaaagagttgcattaaagacagaaacaaagtgtgatatatttgtttcaatacatcaaaatatgtttccgcaaagtaagtgctatggagcacaagtatggtatgcatcaaatgaaaagagctatgaattagcaactaatgttcaagaatctattaaagaaacagttaatgataataataaaagagttgctaagccagcaggagaagcttatttaatattaagagataaatatgaaggggcttcaataatagtggaatgtggtttcttatcaaatccgacagaagagcaaaaattaaaaactgatgaacatcaagaattaattgtaaagggaatatctgatggtatagataaatattttgatggtgattcagagaaaagtgcagaataatagaaatttcccaggaaatttaggagttagtagttgatttttatattaattactaactttttatttttaaatgaataagagcaatcttaggttttagttgtaaaatttatctaaaaataataaactattcatatatacgagaataggaggttcttaaatgagagaaatacatatatcaaaaattattgatacggtaaaagaactttgtattgaagcaaattactatttatcaaatgatgtaaaaaaagcattatataattcaaaaaaaaatgaaacttggccattagcagaaaatatattagatcaaataatattaaattctgatatagctaaaaatgaaaatatgccaatatgtcaggatactggaatggcttgcatctttgttgaagtaggacaagatgtacatattattgggggattactagatgaagctataaatgaaggtgttagaagaggatatgaagaagggtttttaagaaagtcagtagttaaagatcctattaatagaattaatacaaaagataatacaccagcagttatttattataatattgttgctggagataaaataaaaataacagttgctcctaaaggatttggatcagaaaatatgagtagaataaaaatgcttaagccatcagatggattacaaggggttaaggatttcgtaattgagactgtgagattggcagggccgaatccatgtccaccaatagtaataggtgtcggaattggaggaacattcgataaagctgcttatctagctaaaaaagcattaataagaccactagataaaagaaatgaagataagttttatagtgacttagaagaggaacttttagatactattaacaagttaggtatagggccacaaggctttggaggaaaaactacagctttaggattaaatatagaaacatatccaactcatattgcaggtttacctgtagcagttaatattaattgtcatgcaacaaggcataaagaaagagaactgtaggaggattaaaaatggaaaagaagatagtaactcctttaactgaagaaataacgaaaacattagcagctggagatagtgtattattatcaggaatagtttatactgctagagatgcagctcatggaagattaataaatttgttagatgaaggaaaagacttacctttaaatattaatggtgagattatatattatgtaggacctactccagaaaagccaggagaggttataggatctgctggaccaactactagctatagaatggatagctatgcaccaagactgctagatttaggtttaaagggtatgatagggaaaggtgcaagaagtgaagaagttataaattcaataaaaagaaataaagcaatatactttggagcgataggtggagcaggtgctttaataagtaagtgtataaagtcgtcagaagtaatagcctatgatgatttaggagcagaagcaataagaaggctagaagtaaaagatatgccactagttgtcataatagacacagaaggaaataacctatacgaaataggaaaaaaggcatatttagaaagtatttaaatctcaactagtatttccaatagtacttattagcaaaaacattaatatttttagttgttaagttataaataatttattaggataaaagaaaaaaagaaagattatattctaggggaaatttcactaattcccgaagagataatctttcttttttgatattacacgtattaattaaattgttgcgaagccttttcctttaacttcagatacatctattatagtaatgaatgcttttggatcaactcttaatattttagtttttaagctaatcatttgagaagttgtaactgcaacatataatagttttttcttatctctagtatatccaccttcagccataagtgcagtaacaccacgatgcatatcttttattacataattaataatatcatcttctttttcagttaaaataagaagaagttttttactagtaaaaccatttagcactttatctaaaagggtactagtaataaataatgatattaatgtgtatagagctctaggtaatccaaatatgaaaactgaaatagaaactataattaaattgaatccaaatccaactttacctatatcaaaatttgaatatttttttctaataaccatagtaatgatatcagtaccaccaatagaaccatttctataaaatattaatccatacccaattccacttaggactccaccataaatacaatgtaataacatatcatcaacttgaactaaattagataaaggtttagttaacattaatgcagttgagaatgaaatcatacctattgcagtataaattgtaaaacgcttacttaaatatttatagcttacaaagaataagggaatattaagtagaaaaactgttattccagatggaacattaaataaatattgcaaaataagtgctataccagtgactccgccacttagaagcttagcattagataggaatagattaacccctaatgaagagataaagcatcctaaaataattactacaacgtcaatgtaaaaacttttacttttaaataaatctttcataaaaaaatacctctgtattaatatatcgatagttttcataaagattatatattaaaaatataattatgttaagtaatttattttaaatatatgtaacataataatactaatgaataataaaataataaatacaaggaaaataattattgattaataattattatagattattaaaggaaattgaagaaatcaaaaagataagtctttttttttagtttttttgctttataggttattttacaataacaaagagtaagattataattacgatatattgtgtagtgaagagaaaaaatatactatatatagtggaggagcaaaagtggttaatttagaaagtatttgtaaaaaagcagttagtgaaatagatgatttacaaggaatttatgtaaaagaaaagctaattgatggatgtaaaaatataataagagagtcaatgaatgaagaggaagttagaaattctgtaattcaaatagcattagagctaactactgaacaagagcctaagtggcagtatgttgcatcaaaattatatgtagataaattatatgatgaagtaaaaagaaatagaggaagaaaagtagaagataagccatatagcaattattatgaattcatttctgaaatgactgataagaagttatatggaaagtatattttagaaaactatactaaagaagaaatcgaagaattagaaaaagagataaagcctgaaagagattatatatttacttatagtggtatagatctattaacaaaaagatatctaattcaagactataatagaaaacctcttgagcttccacaacaaatgtttatgggaatagcaatgcatttagcaattcctgaagataaacaaaataaattagtgtgggcaaagaggttttatgatgttttaagttctcttaaagcaactatggcaacacctactatgtcaaatgcaagaaaaccattttatcaattaagttcatgttttattgatacagtagaagatagcttaaaaggaatatataaatctctagataactttgcagaagtatcaaagttcggtggaggaatgggaatttatatagggaagataagagctataggatcagctataagaggttttaaaggagcatcaggtggagtaattccatggataaagttatttaatgatacagcagtagcggttgaccaattaggagtaagaaatggatcagttgcaatatggcttgatgcttggcataaggaagtaccagaattcttacaattaaaaactaataatggtgatgatagaaagaaagctcatgatatttttccaggtctttgttatccagatttattctggagattagcagaagaggatatagattctaattggtacatgatgtgtcctcatgagattaaatctattaagggatactccttagaagattattatggggaagaatgggaaaaaagatattatgattgtgttaatgatgacaaaattgataaaagagtaatgtctgttaaggatatagttagattaattattaaaagtgctgcagaaacaggaacaccttttgctttttacagagatacagtaaataaaatgaatcctaacaaacatgcaggaatgatttactcttctaatttatgtacagaaataatgcaaaatatgagtcctatggatattcaaaatacaacaataacagatgataatggagataccattatagttgaaaaaactaaggctggagattttgtagtttgtaatctttcatcaatagtattaggaaatgttgatgtaaataatgatgaagatgtggaatatgtagttgaaactcaaataagggctatggataatgtaatagatttaaattactattcagtaccttttgctgaagttactaataaaaaatatagagcaataggattaggaactagtggataccatcatatgcttgcaaataataaaattcactggaatgaagaaaagcatttagagtttgcagataatgtttatgaaaaaataaattattatgcaattaaatcaagtatgaaaatagctaaagaaaaaggcccatattcatgctttgatggttcagattggcaaaatggagagtattttagcttaagaaattatgattcagataaatggaatgacttaaaaggtgatgtaagaaaatatggattaagaaatggatacttatttgcagttgctccaaatggatctacagcaacaattgcaggaacatctgagggtgtagatcctgttatggcaagattctggctagaagaaaagaagggaagtattgttccgaaaacggctccaaatttaagttgggagaatttctggtactataattcagcttataatatagatcaacagatttgtgtaaagataaatgggattagacagagacacatagaccaagggcaatcatttaatttatatataaccacagaatatacaatgagacaaataatgaatttatatataatagcatgtaaatgtggagtgaagtctatttattatgtaagatctaagtcattagaagttgcggaatgtgaaagttgttctgcgtagaaattgattattatctcaaaagtattaattaagttgaagattaatacttttgagtcatactaagtttaagagcgggagaaaagaaatggaaataaggaagaaacctttatttaatgaaaatggggatattgaagttagtaagaaaaaaatgataaatggaaatactactaacttaaatgactttaacaatatgaaatataaatgggcagcagattggtacagacaggcaatgaataatttttggattccagaagaaattaatctttctcaggatttaaaggattatggaaaattagataataatgaaaaaatggcatatgataagatattatcatttttaatattcttagattcaatacaaacagctaatttgagtaatatcaataattatgtaactgctagtgaaataaatttatgtttaactattcaagcatttcaggaggctgtacattcacaaagctatagttatatgcttgatacaatttgttcaccagaaaaaagaaatgaaattctttatcaatggaaagatgacaaggttcttctagaaagaaataagtttattggagagcaatataataaatttttagaaaatccaactgaagaaaatcttataagaactattatggctaatttcatattggaaggaatttatttttattctggatttatgttcttttataaccttgaaagaaacgggaagatgccaggctcagctcaagaaattcgttatataaatagagatgaaaatacacatttatggctatttagaagtttaattcgagaacttcaaaaagaagaggcagaaatatttactgaagagtttgttgaagaattaagaattatgatgaaagttggagttgaacatgagattaattgggggaattatgttattggggaaaacatacaaggaattaataaaaatctaattgattcatatattaagtatttaggaaataaaagattaaaagaaataggattagagcctttatttgaagggtatgataaaaatccagctccatggattgactcattatcaaatgctaatactgttaaaacagacttttttgaggctaaatcaacagcttatgctaaggctagtgttctagttgatgacttataaattatgttaataaggaaaagatttttcttaaaataataaataaataattttttttaggaggatgcttccacaaaaagataaaatttaaaaaaatttaatgataacgttatttaaaatatgttataatactcatggtcgtattaagtttaaataagataagtttaaaatgggatagatttatcttataaattttcaacagtatataataggtcattaaaattttaacagaaatattatagtggcttaaagtataacaataattttaataatagtattaaatttatgcttaagtgtaggaggaatttatatgaaaaaaggtatcgctgcatcaaaaggttacgctataggtaaagtatttattcaagaacatgaagaaatagttattaatgatgctaaagttgaagacgtagctgcagaaaaagaaaaattaaatgttgcattagaagcatcaaaggaacaattaacagcaataaaggaaaaaacacttgctgaaataggtgaacacgaagcggctgttttcgaagctcacttaacactattagatgacccagaatttactggtcaaatggaaatgacagttgaaaatgatagcttaaacgctatgaaagctgttcaaaatgtaacagatacatttgttatgattttcgaatcaatggataatgattatatgagagaaagagctgctgatattaaggacgtttctaagagaatcatctctaacttagcaggaaaaggtggaagtgcatttgctataactgaagaaaatacagtagttgtagctcacgatttaactccatcagatacagctcaattagatagatcaaaggtttgtggtttcttaacaaacatcggaggaagaacttctcactcagctatcatggctagaacattagaaattcctgctgttgttggtttaggagatataactacaactgttaaaaatggtgatttagtaatagttgatggtattgaaggtattgctataatcaacccatctgaagaagtagttgctgaatacaaagctaagaaagaagcttttgcagcagaacaagaagaattaaagaaacttatcgaagttaaaactgtaactaaatctggtaagagagttgaagtttgcggtaacatcggtaagccagaagatatagatcaagttttagctaacggtggagacggtgtaggattattcagaactgaattcttatacatggatagagaccaagctccaactgaagaagaacaattcaatgcttacaaaactgttttagaaaaagctaacggtaagcaagttgttataagaacattagatatcggtggagataaggtattaccttacttaccattacctgaagaaatgaatccattcttaggatacagagctatcagattatgcttagatagaaaagatatattcagagttcaaatcagagctttattaagagcttctgtttacggaaacctttgtgttatgttcccaatgatttctggattagaagaattccaagctgctaaagaattcgttgaagaatgtagagcagaattacatgctgaaggagttaaaacttcagaaactactcaatggggtatcatggttgaaattccagcagcagcagttatggcagatgaattagctaagtatgttgacttcttctcaatcggaactaatgacttaatccaatatacattagctgctgatagaatgagtgaaaaagtatcatacctttataatccaatgcacccagctgtattaagattaataaagatgactatcgatggagctcataagcacggtaaatgggttggaatgtgtggagaaatggcaggagatgaagctgctatccctacattagttgaatacggattagatgagttctcaatgagtgctacatcaatcttaggtgctaagaagataatattagaacaagaataagatataaagagagaatcgcattagtgattctctttttttattcatattgaccataaatttcttcgtataattcaaaagattttttactcatcagagcaattttatcttttcggattttaagtattgtcattgcaatgttcataaattttcccactcaacaccaattatttatccatgctgtatatatgtctagcaattgcttttttacatttgattttttaataacgcaaatattatttgcagtgttattttaaaggattttagcaaggtttctcttatggtagcttttgttaaagttaatagtattatagtaacatgagttgataattatttaccccaaattataatgttaataatttgagccatatttttattaaaaaaggctcattctatattagtgatagttatagcagctatattgtgattagtattttatttatagtccttgttatagaaggacataataataaaatgaactaatattaaatgtttaatgataattatatatttatcagtttggtatttagtaaaggaggagttaaggtgattaaagttattaaaaatgtaaatgtatatgccccagaaaagctaggtaaaaaagatattgtaatagtaagtgataaaattgaagaaatatatgattgtgtaaatattccaaatgattttgttaatataagtataatagatggaaaagataaaatattatttccaggatttttagattctcatgttcatatcattggtggtggtggtgaagggggatttaaaacaagaactccagaaatatcagtaatttcattagttgaagcaggaataactactgtagttggctgtataggaactgatggggtatgtagagatatgaggtcattaattgcaaaagctaaaggattagaagaggaaggaataacttcatattgttatacaggttcttatgaaataccggtaaaaactataactgaaagtattaaaggcgactttatgatggttgataaaattattggagtaggagaagttgcattatcagatcatagaagctctcaagcaacatatcaagattttataaatactgttgctcaagctagagtaggaggaatattatcaggaaaagcagggattgttaatgttcatttaggggatggggcaagaagattagattatttatttaaattaatagaagaaactgaaattccatcaactcaacttttacctacacatattaatagaagtgataaattatttaaagttggaattgaatatgctaaaaagggtggttttattgatttgacaacaagctcagatccaagatatttagaaccaggtgaattaagagcagcagagggtttagctcttttattaaagaatggagtagatataaaacatataactttttcttctgatgggaatggtagcatgcctgtctttgataattcaggtaagttagttggattaggaatatgttcagttcaaacactttatagggaagttaaagatagtataaatgaacataatgtacctatagaaaaggcaattcaagtaattacatcaaatgtggcagaagttttaaagttagataataaaggtagaatagaagccggaaaagatgcagacattgtaatagttgataaggaaacattggagattgatactgtaattgctaaaggaaaagtattagtaagtgaaggaaaggcaataataaggccgacttttgaataagatttaagggttaccataaaggtaacccttttttgctacaatgtgaaaaataagtgttgtcctatactaattatgttatgtttttctacaccttgcatccaggagcaagtagctatatctggattatagaaaaatacagcatctcctgtaggatcatttccacttaatgcatcataaacagcatcaaagcattcttgagttggttcaacattaatttgaccatcaacaatgcaagaaaaagctctaggttgatatacaacgccttcaattgtattaggaaaaccattgttaagagctctgtttaatattactgatgcaacagcaactttaccctcatagggctcacctttactttcagcatatactacttgagacattaaataaatatctgattgtgttaaataaagcatttgattattttctttaaaaacttgtacgtaatcatcatcagataagtttatatagttatttgtgttactttctaaattagctaaatcgttgtctaatattgtacttgcgcttacttcaatatatgaattatataagcttaagtcaagtgctgaaagggatagtgttagtataatacaaaataagaattttccaaatttcataataaacctccttttggaataacccaatcgagatttattttacccaaaaaatttaaaataatacaaaacattatcaaaaagagtttaataatgattcaaaggaagtttttacatcctcatatttagaaaatgcattttcgtaatatttgtctatactttttttattatcttcatatgatgaagaggatttttcataaataactgcaattttaagagaatttaaataagtagagtataaggaaaacgtattatttacagagttataataggaaatacatccctctggtatagaagaataattaaaatcattttttatcactgttaaagcatcttcttttttctttatatcatcaagtattacatctaatgaacgattatcttttcttattaacttgattgcgggttctaagtcttctaataaatcagaaaaactattagtacatttagtaagcttttcaatataggcattatattgagtagtttttatagagtcttgtttattcagtttatcaattgtatttaaatagctaattaagttatcaaaaaaggtttcgctatcttctggtaactctaaagaaaatccataaggagataattcatcataactactattgcagttttcttttaatactaatatttgtgaagtaatttcagaagctgttaagttacttgtatatgataaaacttcaagacagtatttataaagattttctgtattttctatacaggatgtaagttttggaattatttcaggagtttcattgttagctacaacggttgaggcaaccttttcttttaatgaacttagtttgcttaaatcatcagttaatatacttgaagctgatttagtatttactgttactccattaatacaatcttttaaagtagagttaatagaagaaagttcagtaacgtaaggttcaaattcttttgatgaagtatctgtaataactaatccattattacttaaggtttgaatagcattattatttttatataataatatcatcatagtagatgttacaattacacctatgcttaaagtaattaagaatattttattctcagataatgttttttttatattttccaaaaaaattcacatcctttaagtataattacaatttaaatattatgaagaaatcattttatataatttatattaagaaaaaaggaaattatacttaaaagaggaattaaaaataaaataataatattttaacaattattattatagtgtataatttaattagtaaatttatggtggtggattagatgcaaaactttattacgatagtaatgaattcactaaagagtatgtcagttactgctgttattgatattttagtagtagcatttatattttataaaggatatatgttaattaaagaaacaagagctgagcagctattaaagggaatagcatttattattattctaattccaattagttctattttaaatttaagcatgctatattttatattaagcaagactttgacaattggaataatatctgttgtaataatatttcagcctgaaattagaagagctttagagcatttaggtagaagtgcttttgaagataagcatggtcttgttgataaggaacagagaaatatctatgtaaatgaaattgttaatgctgtatctaacttagcagaaactaaaacaggtgcattaatagcaattgaacaaggaacagggctaggggagattatttcttcaggaactattattgatgcaaaaattactgcaaatttattagaaaatatatttgtagttaatactccacttcatgatggagctacaataataggtaaagatagaatagtagcttctggatgtgttttacctttgactaataatcaagagataaataaaaaattaggaaccaggcatagagcaggaataggactctcagaaatatcagatgctttagttattatagtatcagaagaaacaggaactatttctttagctataaatggacgtttaacaagaaattatgataaggatagattaagaagtatcttactaaagataatggatcatagagaagagaagaatgttaaaactgctggcaagaaggtgaaaacatggataactggaataataaacagaaagtaatagttcaatttgtatgtattttgctatctttaggcttatggatttatgtaactaatattgaaaatccactaaagtcttatgaattaaataatgtgccagtagaaatattaaattcagatagtttgaaagatgcaggattggcgttatctccaaatcaagacttttatgtaaagttaaaaattgaaggtaatacccaagatttatttagtatagataaaagtgattttaagataacggtagatttaagtgaatttgtacttaaaaaaggagaaaataagattgctgtaaacattcaagaagctccaagtacagtaaagattaaaaatagtagtgggctaacaattacagttaatactgaggagtattctacaaaagaggtgccggtaaaatcagagattaatgttatatcaaagtctagttattatgttgcaacaccggtatttagtccagaaactgtaacagtatcgggaccagaatctttagttaacaaagttactaaagtaattgctgaaggcgaagaaagtaatgcagtaaagactattgtgaaaaattacattatatcaccagtggatgataatggtgatgaggttacagggatagaattatcacaaaagtgggttgaagcaactattgaaattaacgaaggaaaaacagttcctataaaaataaatacaacaggaacattatctaatggcttgagattaaaatcaatatcatctgatataacggagattagaataacaggaccagaagggattttaaataatgtaaatgaaattggaacagagataattgatttatctgcaataaaagattcaactactgtagatgttgcattaggaataccagatgggatatcaattcataatggtgaaagttcaataaaagttaatatatcagtagataagtctcagaccaaggagtttacaatttcttattcaataataggaacaacagcagaaggattgactattgtgccagattcagagagtgttacaataacagtatcaggttatgctgatgtattaaataatctaacagagtcaaactttactgcagagttagatgtttcagaatatactgaggctggagaatacactaaagtacctactgtaaatttagttagtgtagataatgttaatatagataacgtaagtgaagtaaaattgactatatctaaagatacgcagactagtactgatcctgatgatagtacaggaaatacagaagaattaaatgaataatttatcgttaaggtcaatctaaatatttggattgaccttaatgaccaatatgaggtgaatatatgacaataagaataaataatctaagccttggtttagatgatgacataagtttattaaagaaaaagataagtaaaaaattaagaatttcagaaaaagaaattgaaaacttaagaatagtaagagaaagtattgatgctagaaaaaaggataatattaaacttacatatgcagttgaaattaatcacaaagatgaagaaaagttagttaatagacttcatgataatgatgtcagggtagatgtatctaagtatgaaccggatgttgaaccaggagctgaaagacttaataataggccagtagtagttggacttgggccagcaggattattttcagcattaatgttagctcaaaaaggttataaaccattggtgatagaacgtggagaagatgttgataaaagaacagagactgtggatagattttggaaaactggtgaacttaatttagaatcaaatgttcagtttggtgaagggggagcaggttcattttcagatggaaagcttactactagaattaaggataaaaaatgtgactatgtcttagcagaacttgttaaagcaggagctccagcagaaataaaatatgaagcaaagccgcacgttggaacagatatactaaaggatgtagtaaaaaatataagaaaacaaataattgctttaggaggagaggttagattttcctctaagcttgaatatataaagagtaatgatggaaaaataaaaagtatagttgtaaatggtgatgaaataccatgtgatgcacttgttttagcgttggggcatagttcaagagatacatatgaaatgttacataaaataggaatatttatggagccaaaggcatttgcaattggtgttagaattgagcatcctcaagaaatgattaatgttgggcaatacggtaagatggcaagtcatccaagattacaagcagcaagttacaatttaacttatcaaagtaaagatttaggtagaggagtatattcattctgtatgtgtcccggtggagtagtagtagcggctgcttcagaagaaaagagattagtttcaaatggtatgagttatcatgcaagagataaggctaattcaaattctgcattagttgtaactgttggaccagaagattttgaaggaacttcagtattaagaggaatggaattccaaaggcattatgaatcattagcttacaaagttggtggtggtggatacaaagctccagttcaattattaggtgattttgttaatgatagaaaatcaactaaattaggagcagttattccaagttatgaacctggctttgaatttgcagatatgagagaatgtttaccttcttatgttgttaatggaattaaagaaggtgtaaataattttgatagaaaaattaaaggctacggaagagaagatgctgtgttaacgggtattgaaacaagaacttcagctccagttaaaataactagaaatgaaagattagaaagtatttctttaagtggtctatacccatgtggagaaggagcaggtttcgctggaggaatagtatctgcagcagtagacggaatcaaagttgcagagagaattatagaaaaatatagtccaatacagtagtattaaaagcaatatatttttaaaagttaatgtttgtgctgcaaatgggaacagtatgattttagatgtaagtagattttattaagcgatattataatgaatattgcatctaaaaacaaattggagtatttacattaacctaggaaaaaagagatattattattgaagggaatattgaaatcgagctgtagaatttaataattgatagaagataatttgcgtgaagaagattatatgtttgagcggtagcaaattatctggaatcaattatataaattcaaggcgaaatttcactaatcctcggaaaaataatatctcttttttgttatttctgctatggttagaaattcaacatgaaattttctgaaaatttaggtttttgtgaaaaagtttggtaaaataaaatataaggtaaatattccatttaattaaaaagaatacaaatacttactaaacagggttattgggaaatgaatatataggagaggtgtaacatgagtaaaagttttgatgatttattaactaagttaaaggtagcaaaaacaaagaagttagcagtagcagtggcacaagatgagccagttttagaagcagttaaagctgcaaaggatagagggattgcagaagcaattttagttggggataaagataagattgaagaaattgctgcaaaaattgatatggatttaacttcttttgaaatagttaatgaagcagatgttaaaaaagctacattaaaagcaattgaattagtatcaagtggtgcagcagatatggttatgaagggattagttgatacagctactttcttaagaagtgtattaaataaagaagttggacttagaacaggaaagttaatgtcacatgtatctgtatttgaaattgaaggaattgatagattagttttattaacagatgctgcatttaatacttatccagatttaaaacaaaaggttcaaattataaacaattctgtaatggtagcaaaatcttgtggaatagaaaatccaaaggttgctccagtttgtgcagtagaagttgtaaatccagatatgccagcaactatagatgcggcattattatctaagatgagtgacagaggacaaattaaagggtgcatagttgatggacctttagctttagataatgcattatctgaagaagcagcacatcataaaggggtaacaggaccagtagcgggaaaagcagatatattattacttcctaatatagatgttgcaaatgttatgtataagtctttaacttatacagctcatactaaaaatggtggtatattagtaggaacatcagctccagttattttaacttcaagagcagatagctttgaaacaaaggtaaattctattgcattagctgcattagtatcagagggtagaaagtaatatacttagggggtattgagaattatggcatataaattattaataattaatccagggtcaacatcaactaaaataggggtttattcaggagaaaaagaagttttagttgaaacattaagacattcatcagatgaaatagctaaatatgatactatttttgatcaaaaaagctttagaaaagaagttataatgaatattttaaaagaaaataatattgatgtgaattcattagacgcaatagtaggaagagggggaatgcttagacctattccaggcggaacttatgaagttacggataatttattagaagatttaaaagttggagtatcaggacaacatgcatctaatttaggtggaatattagcaaatgaaattgcaaaggaagttggaataaggtcatttatagttgatcctgttgttgtagatgaattacaagatgtagctagaatttcaggtattcctgaactgccaagaagaagtattttccatgcgttaaatcaaaaagcagttgctaagagatatgcaagagagaatggaaaagcatatgatgatttaaatcttgttgtagttcatatgggtggaggagtatctgttgctgctcataaggatgggttagttattgatgtaaataatactttagatggagacggaccattttcaccagaaagggcaggatcagttccagttggagatttagttaagttatgctttagtggaaagtatactcaagcagaagtatataacaagatagttggtaagggtggttatgttgcataccttaacactaatgatgctagagatgtattaaaagctagagaagaaggagatgaatatgcttcattaatatttgatgcatttatttatcaagttagcaaagctataggggaaatgtctactgttcttaatggaaaggttgatcaaattattttaactggtggaatagcttattcagctgtagtagtcaaagaaattaagaaaagagttaaatggattagtgatataactgtttatccaggagaagatgaattattagcattagctcaaggtgctattagagttcttgatggagaagaagaagcaaagatatactaagatttaaataatataattgcctctgggattaattcaaggtttgaattaatttcaggggtgattatattatgaaataatattaccataaaaaattaaatggtgttactaaacaaaaaaatattttctatgctttgaaacagtagcatttatagctattcaaggtattatgctcagtattaactattttagctatgttcttttataatgtaactggagatattcatacaattaaagatgaaagaaaattaaaaggacaatttaaaactatttagatgagaaatagaaaagacttaaaataatgtaattattatcttaagtcttttaattttaggtaaaatatatttaatttagaattaaacataattacatatttaatacgttaatgtataacggattaatatatataataaaaagttaacaatagctaacagtattattactcagcaaaattttgggattaaaattactagtgttttagaatcggaagaattggtaaatagcttgaaatgggaaggtgtaagtaataaatctaatattgtggaaataaaaaagtaagaagtaggagtttggaaaaaaatcttaactattaattcttactttttatttactaactataagagctgaattgtttaatgaatattaaatttggatagaattaaggtataatatttatagagtataaaggtgtgggtagttaatatgagaagtaatatagaggttaaaaataagcttactttagtttcgcaaatgggtaatcaatcttgttttcaaattttaagatattcgtcgcttaatggtgcaagtgaattaaatgtagctagggctattaggaccattgaaggtaatggtaagagactaaagcaggttagaatattacttaatgatagatctgttaagattcaagaaggtactctaagctatatgaagggttttattgaaagaagtgatatagtaaatgagtataagggaattaaaagagttatttttggagttactcatatggagcattttggattgaaaactgtttttagtggaactggcgaaatattattaaagcctagttttaatgattttacactaattgaattagttgatgaagaaataataataaatgaagatatgttttatggatgtgatagtgagattaatatttctttaacttcaaatgatagtaataaaatgaatttaagtggatctggagttattgtattgaaattacctgtaccagaagaagagattataagatgtaaattatataaagatagattagttgttaatggtgactttatagtattaagaagtgctaatgtaaaagtaagtcaagaagagtatgaaagaataattgatggagaacttgtagaagaagtaaataatgtttatagtggtataggtgaagtatggattttaccaacaaaaagtatttatgataaatacaccgaagcagattgctttgaaaatgatgaagaaaattaataagctaaagaaaaatttaaagtatacttaaatttagcacactaaagtgttaaaatcatggtatagataaataataggagtgataatatgagcctacagaatttagagtttaaagatgatttagatatgttatttgaagcggttttagagttaaataatatagaggaatgttataagttctttgaagatatagcaacaataaatgagttaagggcaatttctcaaagaatatatgttgcaaaaatgcttacagataaaaaagtatatacagaaatagctgaagtaacaggtgcaagtacagcaactatcagtagggtaaataaatgtcttaattatggacaaggaggatataatttagtattagaaagaatgtatccaaaagataaacaagaataattgatatatagcagtaaagtatggtatattgtaaaaaatcggcataagtaatatactataaaagataatgtctataattaattatttatataagcgaggtattatatatgagtagaatgtttggaacagatggtgttagagggatagcaaatactgaattaactgcagaattagcttatagcttaggaagagcaggggcttttgtattaactgagggtactcataaaccaaagattttagtagcaaaagatactagaatatcaggggatatgcttgaagctgctttagttgcaggaatactttcagtaggagcagaagcagtaattttaggagtagtaccaacaccagcagtagctcatttaactagagaatataaagcagatgcaggagtaatgatttcagcatctcataatccagtagaatataacggaattaaattttttgatggaaaagggtacaaattatcagatagtttagaagaccaaatacaagctgtaatagaaggtggatttgaaggcgtacctagcccaataggtggaaatgttgggagatcatacactgaagaaacagcattaagagaatatattgattatgcattaagtactataaaaacagatttaaagggactaagagttgctttagactgtgcaaatggtgctgcatataaagcggcagtaaaggcttttaggtctttaggggcaagagtatatgtaataaatgataatccagatggaaataacataaatgaaaattgcggatcaactcatatggaagaattaatggattatgttgtaagaaagaactgtcatattggttttgcatttgatggtgatgctgatagatgtttagctgtagatgaaaagggaaatatgattaatggtgatttcttactaactatttgtgcaaaagctttaaaagaagcaaataaattaattgatgatactttagtagtaactgtaatgagtaatttagggttagatattgctgctaagagagaaggaattaacttagttaaaactaaagttggggatagatatgttcttgaagaaatgcttaagaataattatgtattaggtggagaacaatcaggacatatcatatttttagatcataatactacaggagatggattagttacagcacttcaagtagctgctattcttaaagagagtggaaaaactttcagtgaattggctggagttatgaaagaattaccacaggtattagttaatgctaaggtaccgaatgaaaagaaaaacatatatttagaagataaagaaataatttctgctatacaagaagttgaagctaagctaaatggtgttggaagagtgcttataagaccatctggaactgaaccattagttagagttatgcttgaaggtgaaaatcaagaagaaatagatgaaatggcacataaaattgcaaatttaatattaagtaaaatataattattaaattataatggcgtattaaagttaagagtaaaattaattttaatacgccatatttttttgtaataaattaataaaaacaatattaaaaataaaaagaagtgttaaaaaggtaaagttaaaatataaacataaaaaatgatggtgttattaataaattaataagtttaaaataaatttattaaattactaagaaattaataaaaatattaactatatgtaaaaaacagctaaaacaagatcctaaatataattaatatggtaaattttgaaagaggctattgacagtatattaaagtaaagagtaatatattaacaatagaatattttggaaggtcctttttaaggaataaaagctgtgatagagacgtttatttagaataaaaagtttcagagaatccatggtagctgtgaatgggtacttttactaaataataatcactcttgagctgtaacctgaacattagtaaaaatttatctaatggctagatgttgtaacactcttatctatttgtgtaagataacagcggataagcctctagataatcaattctaaccttaaggcggagttaaatatccatcttaagataagaattcagtttataagtagggaattaccggtaagcaccgttatatgcaagggtttgttggaacctagtgatatttaatgatgaggaatgttatcccgccgttatgattttatcattaagggtgggatttttttaatctaaattcattccgttttattcaaaaatttgaaattatttgattgggggtatataaatggaaaggtatgttttgtcagttttagttagaaattcttcaggggtactaacgagagtttcagggctatttgcaagacgcggatttaacattgatagtttaacagttggaagaactgaaaatccagaaatttcaagaatgactattacgttaaatggaagcgaggaagtactagagcaatttatgaagcaattaaataagttagaagatgttttaagggtattacaattaaaaccagacaactcagtttatagagaactagtattaattaaagttaaagcagattcagagcaaagagcggcaattaatgaagttgttagaatttttagaagtaagattgttgatatttcaccagagacattaacaattgagcttactggagatgaaagcaaaattaatgctcatataaagttaatggaagagtatgaaattaaggagttagttagaacaggtgtctgtgcattagaaagaggatctaatgatataacagattactgcgaaatctttaattagttaatagttaagagtttaatgaagaaacttttatgagtttttaaaaatatattttttaaattcagctcagctgaaattttccttaactataaactcaaagctattaaataacgaatctattaaataacaaagcagtaataagtaattaaattgtgataagtcatagtggctagtataactaaaaaagttaacttaataactatagtattattgaagttaagggttaatcaatagtaaggagacaagtattaacttgccacttttaacttatcacttacgaaatgggggtagagttttgaatagaaccattgaaatttttgattctactttaagagatggtgctcaagggcaaggaatatcattttctttagaagataaaacaaaaatagttaagatattagatgatatggggattgattatattgaggctggaaatcctggatcaaaccctaaggatatgcaattctttaaggtaataaaagaaatagaacttaaaaattcaaggttagttgcttttggatcaacaagaaaaccaaattcaaaggtcaatgaggatattaatataaaaagcttattaaatgcagaaacaagtgttatatctatatttggtaagtcatgggcatttcaagtaacagatatattaaagactacattagatgaaaatctacttatgataagagaaactatagaatatttgaccaaaaaaaataaagaagtaatttttgatgcagaacatttttttgatggatataaagagaataaagaatattctatgttaacattaaaggccgccagagaggctggagcaaaaacactagttttatgtgatacaaatggtggaacattaccaagtgagattaaagaaataattactgaagtagctaagagtttcgaatgtaaaataggaattcattgccataatgatataggtatggcagtagcaaattcaattatggcagtagaggcaggggctatacatattcaaggcacatttataggagtcggtgaaagatgtgggaatactaatttaagtacagtaattccaactatagccttaaaaatgaattgtaatttaaaggctgaaggtcacttgccagaattaactgcaaaggctagatatatttcagaaatatctaatatccaattagaagattcaactccttatgtgggtaaatcagcgtttgcccataaaggcggaatgcatatagatgcaatttgtaaaacaccacaatcatatgagcatgtaaaaccagaggtagtcgggaataagagaagatttttattatcagaggtaagtggaaagagtactgttttacaagagatacacaagatatttcctaatgtccaaaaggatggagaggaagttaaaaaggtaaccaaaagattaaaggaattagaatatgaaggttaccaatttgaaggggcagaaggaactgtagagttgttaataagaaaaataattggaaagtataggccatttttcaaattaaatcattttaaaaccatgggagaagcaccttggaataatggtgaatttagctcaacagctttaattaatataacagttgatggaaaaaatgaaatgacagcagcagaaggggatggaccagtaaatgctttagataaagccctgagaaaagcattagaggtcttttatccagaattaaaaagtataaagttagttgattataaggttagagttttagattcagaaagtacaactggtgcaaaggttagagttttaattgaaagtactgatggaaatgaaagttggagtactgttggggtgtctaaggacgtaattcaggcaagttggattgcattagttgattcaatggaatataaactaataaaagatattgaaagaaaagcaaaagcatatttctaaagggggaaaaaacaatggcaatgacaatgactcaaaaaatattagctgctcatgcaggattagaaagtgtaaaggcaggacaattaatagaagcaaatttagatttggtgttaggtaatgatattacttcaccagttgcagtaaaagaatttgagaagtttggagtaaaaaaggtttttgataaagaaaagatagctatagtaccagatcactttacgccaaataaggatataaaggcggcagaacaatgtaaatttattagggaattctctagagataaaggaatagttaatttctttgaaatcggagaaatgggaatagaacattgtttattacctgaaaagggattagtggttgcaggtgatgttgttataggggcggattcacatacttgcacatacggtgcattaggagccttttctacgggaattggttcaacagatatggcagctggaatggctacaggaaaatgttggtttaaggttccttcagcattaaagttcgtattaaagggaaagccttcaaaatgggtaagtggtaaagacgttatacttcatattattggaatgataggagttgatggagctttatataaatcaatggagttcgttggtgatggattaaatcatttatcaatggatgatagatttacaatggctaatatggcaattgaagcaggtgggaaaaatggtattttcccagtagatgaaaaaactattgaatatttaaaagaacatggaaagaaagaatggaaagtatatgaagctgacgaagatgctgagtatgatgaagtttatgaaatagatttatctactttaagaccaacagtatcattcccacatttacctgagaatacaagaactattgatgaggttggtgatgttgaaattgatcaagctgttataggttcatgtacaaatggaagaatatcagatttaagagtagcaagagatatccttaaagggaaaaaggtaaataaaagagttagatgtatagtatttccaggaactcaaaagatttatttacaagctttagaggaaggaataattaaagatttagtagaagcaggagcagttgtatcaacaccaacttgtggaccttgtttaggtggacatatgggtatattagcaaagggtgaaagagctatttcaactactaatagaaattttgttggaagaatgggacatgtggaatcagaagtttatttagctagtccagcagttgcagcagcttcagcactaacaggaaaaataactaatccggaaacactttaagggggtaaataaagatgaaagcaacgggaaaagtttttaaatatggagataatgtagatacagatgtaattataccagcaagatacttaaatacatcagacccaaaggaattagcaagtcattgtatggaagatattgatttaagctttgcaagtaaagttgaaacaggggatataattgttgcaaacaaaaactttggatgtggttcgtctagagaacatgcaccaatagcaataaaggaaagtggaattagctgtgttatagcatcgacttttgcaagaatattttatagaaatgcaattaatattggattaccaatattagaatgtgatgaagcagttaaatccattgaagcaggggatgagttagaggttaattttgatacaggggttattaaaaatttaactaaggatgaagaatatcaaggagaagcattcccagagtttatgcaaaatattataaataataacggacttataggttatataaagaataagaataaataaaataaagggcaatgggcaaattttaagggggaagaatcatgaattttaatatagcagttataccaggagatggaatagggccagaagttatcgatgtatcaataaaagtcttaaataaaattggggaaaaatacaatcatacatttgaatttgagtttttacaagccggaggatgtgcaatagattcaatgggaacgccacttccagaaaaaactttagaaatatgcaagaaaagtgatgcagttcttttaggtgctgtcggtggccctaagtgggatgatcctaatgcaaaggtaagaccagaacaagcgttattaggattaagaggtggcttaaatttgtattgtaatttaagaccagcacttttatataaaccattaaaggaagcatcaccattaaaggatagcataattggtgatggaattgatatttgtgttgtaagagagcttactggaggaatttactttggtgaaagaggaagagaagtagttaatggaatagcttcagcttacgatacagaaagatataatattaaagaaatagaaagaatagttaaaattggttttgagactgcaatgaagagaaataagaagcttactagtgttgataaggctaatatattagaaagctcaagactttggagaggcgttgttgaacaaatgtctaaagattatccagaagttgaagtaaatcatttatatattgataatgcttcaatgcagttagtaagggatccaagacaatttgatgtaattgttacttcaaatatgtttggtgatattttatcagatgaggcttcaatgataactggatcaattggtatgcttccatctgcatcattaggagaaggaactttaggaatgtatgagccaattcatggttctgcacctgatattgcagggaagggaatagcaaatccactagcaacaattctttcaactgcaatgatgttaagatatagttttaatttagaaaatgaagcaaaagaaattgaaaatgcagtagttaagatattagaagaaggatatagaactggtgatataaagagtgaaggaactacacttgttggaactaaagaaatgggacagcttgttttagaaaaactttaaatagttaaaagctaaaagttagtagttaatatggaaattccttaaggattttcttaaatatataactaagaactcaaaactactaactattaactaacattaagggggatataaatgagaagtgatgtagttaaaaagggagttgctaaggctccacatagatctttgtttaaggcatcagggttaactgatgaagaaatagataaacctttgattggaattgtaacatctcaaaatgatataattcctggtcatgttaatttagataaaattgttgaaggtgttaaaaaaggtgtattaatgtctggaggaacaccattagtatttccgacaataggtgtatgtgatggaattgcaatgggacatcaaggaatgaaatattctttagtaactagagagcttatagctgattctgttgagtgtatggcaaatgctcatgcatttgatgctctagtgtttataccaaactgtgacaagatagttccaggaatggttatggctgcattaagagtaaatgttccatcagtaatagttagtggtgggccaatgctagctggtaaattcaaaggtaaagaagtatctttatctacaatgtttgaagctgttggttcagttgaaagtggattaatgcttgaatcggatttagcagaattagaagaaaaagcatgtcctacttgtggatcatgttcaggtatgtttactgcaaattctatgaattgtttatgtgaagttttaggattagcattaccaggcaatggaacaattccagcagtttattctgaaagaataagacttgctaagtatgcaggtatggctgttatgaatcttttagaaaaagatattaagccaagggatatagtaacagaagatgcaattaaaaatgcattaacagtagatatggcacttggatgctcaacaaatagtgttcttcatttaactgctatagcaaatgaagctgagttacctataaatcttgatattataaatggaatgtcagcgaaggtgcctaacttatgtaaactagctcctgcatctgatactcatatagaagacttatatgcagctggcggaattagagctataatgagtgaattaaacaagaagaatttattaaatttaaattgtattactgcaactggtaaaactgttggagaaaatattgaaaatgcaaaagttttagattattcagtaataaaacgtatagaagaaccatatagtcaaactggtggaattgcagttttaaagggaaatttagcaccagatggagctgttgttaagagatcagcagttttaaaagaaatgttggttcataaaggaccagctaaggttttcaattctgaagaagaagctattgaagcaattatgggtaagaaaattgttgaaggcgatgttgtagttattagatatgaaggtccaaaaggtggacctggaatgagagaaatgttatcacctacatctgcaatatgtggaatgggacttgataaatctgttgcacttattacagatggaagatttagtggggcaactaaaggtgcagcaataggacatgtttctcctgaagcagctgaaggtggaaatattgcgttagtagaagatggagatattatttctattgatattacaaatggtaatttagatttgcttgtcagtgatgaaaaactagcaaagcgtagggcaaacttaaaaccagttgagccaaaagttaaaggaggatatttagcaagatatgctaaattagttagctcagctagctcaggagctgtatttaaatagttaactaaaaactattaattaaatataaagggggttattttcaatgttattaacaggtgctgagattcttgttaagactttattaaatgaaggtgttgacactatttttggatatcctggaggatctgtattaaatatttatgactatttgtataaatacagagatcaacttaaacattatttgacttgccatgaacaaggtgcagctcatgcagctgatggttatgcaaggtcatcaggaaaagttggggtatgtattgctacatcaggcccaggagcaacaaatcttgtaacggggattgcaactgcatatatggattctgttccattagttgcaataacaggtaatgttcaaaaaagtctgcttggaagagatagctttcaagaggttgatattactggaataacaatgccaataacaaaacataattttattgttaaagatgttaatgaattagaggaaactgttagaaaggcattttatattgctagggaaggaagaccaggacccgtattaattgatattccaaaggatattacatctgataaaacagaatataaaaatttaaagccattaccagtggaaccaaaaagtaagcatattactgttgattcattaaatgaagtagctaaatacattaatgattcagaacaaccacttatttatgcaggtggaggagttattaattcagcggctactgaagagctagttaattttgcagaaaaaattaatgcaccagttgcaacaacattaatgtgtagaggggcaattccttcagaacataggttaaatactggaatgatagggatgcatggaagtaatgcatcaaatattttagcaactaagtgcgatttaataattgcattaggtgcaaggtttagtgacagggtaattagcgatagagaatttattaataatgctaaggtaattcaaatagatgtggatccggcagaagtaaataagaatgttaaagtagattcatttattataggggatattaaggtagcattacaaagattaatgcctttaatagattataagaaaaatgataagtggttaaaaaaagtagatgaattaaaacttttagctattacaaaaaataataaggatgatggtgagcaattaacaccaagatttttatttgaaaagcttagtgaattagataaaggtgattttattatgacgactgaagttggacagcatcaaatgtggacagcacagtattttaattttaaaacaccaagaactttaatttcatctggaggacttggaactatgggatttggtttaggtgcggcaattggagttaaggttgctaatccagataaaactgtatttaacattgctggtgatggaagctttggaatgaactgcaatgaatttgcaacagctgttaaatataatattccaattaaaattattgtaatgaataacaatgcattaggaatggttagacaatggcaaagtttattttatgaggctagatattctcaaactactttagatagagctactaattttgttaagcttgctgaagcatttggaggcgttggatttaaggtggaaaaaagagaagaacttgattctgtattagaagaggctttagctgtagatagaccagtaataattgattatagaattgatagtgataaaaaagtatttcctatggttgctccagggtcaccaatccatcaaattataaatgaagaagatcttgctggggaataggcaataagtaatagataaaaattaataggtaataagtataattaaatatttttcactttttatgtattagttaatgataaaaagttagtttaaatttctatcataaaaatttgatagtgaatttttataaataaaaaataaataagtcgggggtataaaaaatggcaaagatgttttatgaaaaggacacaaatttaggtttattaaaaggaaagaaggttgcagttatcggttatggtagccaaggacatgctcacgcattaaatcttcatgaaagtggaattgatgtagttgttggattatatgaagggagtaaatcatggaataaagttaaagaagcaggattagaagttgctacagttgcaaatgctgttaaatctgctgatgttgttatgattttagtaccagatgaaaagcaagctaaattatataaagaagaaatagctccatatttagaagaaggaaatgctttagtatttgctcatggatttaatattcattatggacaaatagttcctccagcaaatgttgatgtatttatggttgcgccaaagggaccaggacatatggtaagaagaacttatactcaaggatcaggagttccttgtttaatagcagttcaacaagattacacaggaaaagctaaagaatttgcattagcttatgctaatggaattggtggagctagagctggtgtattagaaactacattcaaagatgaaactgaaacagatttatttggtgaacaagcagttctttgtggaggtgttacagcacttattaaagctggatttgaaactttagtagaaggtggatatgctccagaaaatgcttactttgaatgtttacatgaaatgaagcttattgttgatttaatataccaaggtggtatggcagcaatgagatattctatatctgatacagctgaatatggtgattacatgattggtaatagaatagttactgatgaaactaaaaaagaaatgaagaaggttttaactgaaatccaagatggtacttttgcaagaaattggttaatggaaaaccaagttggaagaccacaatttaatgctatgagaagaatggaatcagaacatcaaatcgaaaaagttggtaaagaattaagagaaatgatgtcttggatcgatactaagaacttagattaataaattatagcttttttgattaaataaatgtaggaaaaggaattacagttcatagtagagttgtaattccttatttttgtataaattcacaaaaaccataagatctaaaacaatgacatgtaaaattatagtattaatattaaaatttaataatgatgttttggtttttaaattatatttaattattgattggaggagagaaaatggaattaaaaactagagtagatgataagaaagtatttgccaaaattggactagccacttttgtttgtatgatagtagtaaatgttatacaagtgatttattattcagttattaatttaattaatccgtcattattgcaacaaccttggataaattatgtagctattgcaattagtttttatcttataggttttcctatattttatgtgatggttaagaaacttcctgatggtgaaaaaagggaaagtaaaagcttaagtgtaggaaaaataattttattattttttatgtcttatgcaatattatatgtggttaattttttaactacgcttttaatgatgttaattgcttcaataaagggaggtgagataataaatccaatagcgaatgtagtaggagcgagtaattggatttggagtttaatctttgttggtatattatctccaattgttgaggaaatgctatttagaggtataatgcttaataagataagaatgtatggtgataaagtagctatagttacaacagcagttttatttggattatttcatgcaaatttttcacagtttttttatgccgttggattaggagttatatttgcatatgtaacattaaagactggtactataaaatattcaataatattacatatagcaattaatattgttggaagcgtaattatgccagccatagttggagatggtagtaatatagcactaataggagttgcgggatttattttaatagcaattactattataggaatagttttattaattattaatagaaagaatatacatttatcagaaggtgaaataaaattggaaaagggtagggttacaaaaactatttatttgaatgtaggaatgattttatatatagcgctttgtgtaatatcaatgatatcggtggtaatgatgtaaagtatagattaaatttgtacattaatgacatttgcaaatatagagttatttatttgcgttataattactggaattaaaatctaaattagataaaaataataagatttgaaatttattttttatagatctatattatcctatattggtattttatagatctattttaatgtataatctataaaaatacgaacattaatgtttaaaaaagtgagaaaattatggaatttggttgtatttatggacaatttattgtttttatattaatattattcttatgataaaaagtaatcgtgtttatcgtataaagttggtaataaggtccaaccgtatctaccaagtcaccataaatgacttgactacgatatttcttaaataaagagtatttttaagaaattttatatacaatcataaaaaatatacttacacttcaaatatccttagcatgcgataaatagaacggttactaaaaatatgcatggagggaataacaaatgatgaatttcatatcgaattattttaattttcaaggaaaaagaacaaatttaaagacagaaacgatagcaggaataactacatttttaacaatggcatatgcgctttttttaattcctagtgttttagcagatgcagaaatgccagaaaaaagtgtctttgttgcaacagcattagcagcagcaattggtactttgattatgggtatatttgcaaaatttccaatgggactagcacctgggattggattaaatgcattttttacatatagtgtatgtataggaatggatattccatggcaaacagctttatcaggtgtacttgcatcaggaattattttcttaataatatcagcaacaggtttaagagaattagttattaaggcaataccaactaatttaaagtttgctgtaagtgcaggtattggattatttatagcttttattggtttaaaaaatgcaggaatagttgtagcaaatgaagcaacatttgtaggccttggggatttaacaaatccaacagttttactttcaatatttggccttattgtaatggcaatattaatggttagaggatctaatatagcaatatttattggaatggtagcaacagtagttgttggaatgatatttggattaattaatttaccaacttcaataatatcaatgccaccatcaattgctccaacttttggagtggcgattaaaaatttaggaaatatttttaatccacaaatgattttagttatatttactttcttatttatggatttctttgatactgcaggaacgttagttgcagttggttcaaaggttggattacttaaaaaagatggttcagttgaaggcggatctaaagccttacttgcagattcagttgcaacttgtataggatcagtatttggaacaactaatactacatcttatgttgaatccttatcaggggttgcagtaggagcaaaaacaggattttcaagtgtagtagttggattattattcttagtttcattattcttctcaccattacttacagtaattacttcagcagtaactgcaccagcacttattatagttggttcattaatgtgtagtaatcttaaagaaattgaatgggataagccagaagtttcaatttcatcatttttaactataatattaatgcctttaacatatagcattggtgagggtatagcatgtggttttttatcatatgtagtacttatgatatttaaaggaaaagctaaaaaggtacatccagttatgtatgtattagcatttttatttataatatattttgcagtaagataaaaatttttatttataaaattgaagctgaattataggtagaagataattcagcttcaatttatttttatatattcactttagtataaatactttacaataataattgtaatctgtataattaatctgtaatttgaaaataatagttaatataattgtgttgattaggagcagtaaatagaactttaatttaaagcgatttaggaagtggtgtaagcctaaaatttaaaactattgaaggaaacctaggagcaataaaattaaataagtatttgagtgggttaatttatattaaccaatttaggtggtaacgcggaaatacagtctttcgtcctaaaagtttaggatgaaagactttttattttgtaaaaaataaataagattaaaaggagaaaagtaatatggcatttgaaaagttagctgaaatgatattcccaaatgtagaacatgatagagaatattatatagcaaaatacccaaagagaaatttaaaagaaggtgctagagtaactagatatgcaccatcaccaacaggattccaacatataggtggagtttttgctgcattaataaatgaaagattagcaagtcaaagtgaaggtgttttctatttaagaatagaagatactgaccaaaaaagagaagttgaaggtgctatagaagatacaattgcaactatgcacaattttggaatggacttcagtgaaggaatgactggtcaagaaacttcaaaaggtgaatatggtccatatagacaaagtgaaagagcagaaatatatagaacttttgccaaggacttattattaaaaggattagcataccctgatttctgcactccagaagagttagcagcattaagagaagaacaaattgctaataagataactcctggatactatggagaatatgctaaatacagaaatattactgaagaagaagctattgaaagaataaataatggtgaaacttatatcttaagattaaaatcaccaggaaacattgaaaatagagtagaattccatgacttaataaaaggagatatatctttcccagaaaacaatcaagatgttgttttaataaaaggagatggacttccaacttatcattttgcacatgcaattgatgattatttaatgagaactacagatgtaataagaggagaagaatggttatcatctcttccaatacatgttcaattatttgaagtattaggctttgaaagaccaaactatgctcatattccaacaataatgaagcaagaaggtggatctaagagaaaactttctaagagaaaagatgctgaagcagctgtatcttactataacgaagttggatatccagtagtttgtgttattgaatacttattaaatatagtaaactcaagctatgaagaatggagagcagaaaatcctactgctgattaccatgaattctatgttgctttagaaaaaatgagcaagagtggagcattatttgatttagttaagttaaatgacgtttctaaagatgttattgctagaatgccagcaaacaaagtatatgaacaatatacagcatgggctaaacaatatgatgaagaaatgtataacttagtaacttcaaatgaagctatgtctaaggaaatattcaacatagataaagaaggtccaaagccaagaaaagattttgctaaatgggatgaagttaaagaaaagattttctatttctttgatgaattattctataatgaaacagcagatcaagttgaattaccaaagactttatcattagaaaatgctaaagctgtaattgaagaatatgctaagaagtttaacttcaatgctggaagccaagaaaattggtttgaagatttaaaagtaattggagcagaacttgggtactgtgcaaatagaaaagaatataaagctaatccagagcaatataaagggatgatctctgatgttgcaggtgcagtaagaagtgcattatcacatagaacaaatactccagacctttatactataatgcaaattattggtgaagataaggttaaagaaagatttaataaatttttagagctataagataatataaaattttaaaatatgttgatgtttagctatattaattaataattataaatcatatattatttaaagtaatatttgccatgtattatataaggtaaacttcataaaatagtatcgaaaatagaaatggaggtaattttatgaataataattcaaacatgaacaaacaaaatattaataatcaacaacagggtaatatgcaaagtaatactcaacaaagtatgaatagcagtgctcaacaacaaagcaatatgcaaaatagtgcaaactctcaacaaggaatgagtagtgctcaaatcgattcaaacatagaagcttataaaaaagcacaacaaaatgctaatcaaaattcaatgcaataaaaatatttgagttataaaaactccttataattaggggtttttatttttttatagttataaaaatgttaaaaaaatttaaaatggagaactagatacataaaattatattacaggaaaaaaggacttattatagtaacaagcacaattaatacaaggtatcaaagatgataaaaagtacaaactattaatgtagcggtggtagaactaagttaagacttggctgtatcagggctaaattcaaaagtacactggaggtaaatgttatggataaacattcaaagtgtggatgtcatacaaaagaaaaaagtagttgtgaatcaagttgcggatgtggatgcaatagtggagcaccaaaatctgcagtaaataatcaatgggcatcaccagctggtgtaaaagtagaaaattataaggattgcacatgcgaaaaaaaagaaaaaactgcaaccaataatcagtggtcataatttaaaatcaatttatagaaataaattctagtattaaattaataatatggaacaaaataatattgataagagtgttggagaaaaattgatgggatgaagattaaaaataattaaatcttaaacaatttaactgatgtctatagtttttgcaccgaaagaaaaattatagagaaatgattatataagtggcagttcagtgtaaatccgattaaaagtattactgtgtatgaaacctcaaaaacactcactatacctaattaaaataagagaaaggcaaatgcctttctcttatttttctttttattttaatttaaatgaagattttaaagatacaattctgttaaatactaatttatcagcagttgtatacttagtatcaacattaaagaatccatttctaactaattggaacttatcttgaggtttagcatccttagcagctgttggctcaataaatccttgtaaaatttctatagagtttggatttatttgttctaagaaattcttaccttcattttcaggaacatcatctaagattaatggttcatataatctaaattcagcaggtacgcagttgtttgcatctacccagtgaatagttcctttaacttttcttcctgtaaatccagaaccacttttagtttcaggatcataagtacagtgaatttcagtaacattaccattttcatctttgataacttcattacacttaacaaaataagcacccattaatctaacttcattaccagggaataatctaaagtatttctttataggaacttccatgaagtcttcttgttctacatataactctcttgagaatggaacaagtcttttaccaaaagattcatctttagcattattgctaacttcaagcatttcagtttgcccttctggatagttagtaataactaattttaaaggtcttaaaactgccatggcattaggagccttcatttgtaaatcttctcttacaaaataatcaagcatttgagaatctactgtagagtttgctttagcaacaccaattgctgaacagaaattctttagagcttctggtgtacaacctcttcgtcttaaaccagaaatagtaggcattcttggatcatcccatccatcaacaacaccttcatcaactaattgcttaagttttctcttactcataacagtattagtcatatttaatctagcaaattcaatttgtctaggttggcaatccatttcacattctcttacaacccaatcatatagaggtctatggtcttcaaattctaaagtacaaatagaatgagttacattttctatagcatcttctaatggatgtgcaaagtcatacattggatatatgcaccatttatcacctgtattatgatgatgtgcatgagcaattctataaataataggatctctcatgttcatatttggagaagtcatatcaatttttgctcttaaaactttttctccatcagcaaattctccattcttcattctctcgaataaatctagattttcttcaacagttctgtttctataagggctttctttaccaggttcagttaaagtacctctatattctttagcttcttctggtgttaaatcacaaacataagctaagcctttctttattaataaaacagctctgttatacatttcatcaaagtaatttgatgcaaagtaaagttcatcccattttccaccaagccattctacatcttctttaattgattgaacatattctgtatcttcttttacagggttagtatcatcgaatctaagatgtgttttaccatggaattcttcagctaatccaaagtttaaaagaatagattttgcatgacctatatgtaggtatccatttggttcaggtgggaaacgtgtaattatttccttatgttttccgttttctaaatcgtcaattattatgtttcttataaaattagaagaattaatttcacttgacatattttacctctcctattaacgcttaattatttaagttaaaaatattcttaaaggaatttaaaattattctataaagaataattatgtcctaagtaaataacatttataacatatattttaactattactaataattttaatcgaatataagtaaaaaataaagtaacttatagaaaaagttagataattacttcatgaaagtataaaaaagtaagcttataacaataatatatagagaattatgtactaaagaggaggtataagaatgaataatttatcatgtaatgttactacatgtatatataattcacaaaacttgtgtagcaaagaaagtattaaaattgcaggtaaaaatactattacagccaattttacaagttgtgaagactttagaagaaaaactggtgaacttactaatagtgttaaatcagctaatacaatgttagatgtaacttgcgaagctataaattgtgaatataacaaagataataaatgtgaggcatcaaatataacaattggtggagattatgctttatctgaaatacaaacagaatgttcaacttttgtatcaaagattaataaatagataaataatgtaaggctagctataaatatattatttaggattaagaatatatttattaaataagctagcttttttatgcaatcttgtttacattaattggtttttaaaataaaatagatatataaatcaattaaaaagaaaaggattaattttaatgaagattaattatataagggaattaaatagtagcaaaataaatttaagtccattaaacttttggcaggctataggaataacaattttatttgatataataactttatttttaaataaacctacggatattttttatattatattaaatagtttaggagttgcaacatatagtggattttggatgtggatatcgacagcattatctgcagcatatgagtttggtgcaatattaatattaattatttttctaaacaataaaaacaataaagtaaataatataaatactggttttaagttgagaaaaagagattgggtattagttccgctactaatagtttcatatattttattaacttatggatggtttgattatattttatatttctttccaacgggtaatacatatgaatatgttattgattatttaaattcaattccgatggttatattgatgatagaatcttgtgtaatggcacctttttttgaggaactattgtataggggaattatattaaatggattaattaatagatatagtggaaaaaaagctattgtttattcagcattaatatttggaatagcgcatctgaattttccacaaggaattaatgcatttttattagggttaataataggaactgtatattattatacaagatcaatatatttatgtatgataatgcattttgctaataacttcttagttaattttgtttattatccaacttcacagttatggacaaacattttatttgtattacttcctatattaggtttagtgttaatgatttacttatttaagatattaagtttaaaagagagaagtaaagaagctattaattatataataaataacgattttaaataaaatgagtgatgaaataattagcatttatctttaaatagataagtgcttttataatataaaattgggggtgaatactatgaatattgggttaattggatttggaagagtaggacaagcactaataaaattgttaatagataaagaaagttatttattgcaaaaatacaatttgaaaataaaagtaaaatacataataaaaagcaatggaggaatatacaatccttctggaataaatttaagtcagatattaaaatttattggtgaaaatataagtattacatgtcacaatgagtggaaagataatttgaatattaatgatattattgataataatgatatagatactttggtagagttaacttcaactaatatagaaactggtgaaccagggcttactcatattagaaaatcattaaaaaataatataaatgttgttacagggaataaaggtcctattttattagattataaaaatttaaaagttttatctgatagtaataatgtggagcttaaggttggatgtacaacaggtggagcattaccttcaattaatggaggaatatatgatattgcaggtagtgaaattcaaagtattgaaggtatattaaatggtacaactaattatatattaagtaaaatggctaatgataatatagactataaagaagctttattagaagcacaaaaagatgggatagcagaagccaatcctagtttagatgttttagggtatgatacagcaagtaaaataattattttatcaaatgtacttatgaattcagatttaaaactagaagatttaaaagttaatggcattgaagaagttagaatagatgatataaaaaaggttaaaagaaagggaaataagataaagttaattggtaaagtatataaaaaagataatttagttaaggcttatgtgaaaccaatagaaattgatgaaaaccatccattatattgtgttgattataaaaataagggaatatattataaaacagatactttaggggatataagtataattggaggagcttctggaaccatgaatgctgctgcttcaatattaagggatataatattaattaagggtgtttagataacaatactgtgtaaaatattgtatgaattttaattatttataaaaaatgattaaaaaaggttgcaatttaataaatactatgttattataagagagtagcaaagttgctaacaaaaaaagtttcatttaggtaaatagtttctcgaaaattagagattattatatcaatttagaatctttaattttaggaggaatatttatgacagataaaacattagtatgtagagattgtggaagtgaattcgtattttcagtaggagaacaagaattctacaaagaaaaaggattcgataacgagccaacaagatgtgtatcttgtagaagagctaaaaaagaacaaaatagaagataattttagattattataggttgtagtttaaactacaaccttttttgattatattaaaatataaaaattaactaataaaatatgtagtagggttagagtataatgataaataagaatgtcacttaatatagagatgtataaaaagcaagatacagatggatagaaagtaatttggggagcgtgagactcatggataagaattatataagaaaagaaatattgaagacaagaaatgatatagaagtagttttaaaaaaagaatatgatagtataatctttaaaaggttgattaatagtgatacttataagaatgccaataaaatatttacttatataagttttggttcggaagttgatactaaggaatttataaaatatgcattaagtgataataaagaaatttatgtaccaaaaaccgataaaagtaaaagggaaatggtagctatgaaaattaacagtttagataacatgggtgtagataagtggggaatacttgaacctaaaactatggaagaagataaaattggagaagaatttgatttaataattatgccaggagtagcttttgataaatttggaaataggattggctatggtggaggatattatgataaatatatttctagaaaaaatattaaatgtcctaaaattgcattggcatatgatttgcagattattgataaaatacagtgtgaggaacatgatataaaggcagatggggtaatatcaaataaagagtttataaaaatgtaaaaaattataaaaatcattgaaaaaatattccatatgtgtataataaagataacaagtaaataaaaatcttttattaagaacggtggagggactggccctgagaaacctagcaacctgttatcagtgacaagttgtaagtgacaagttatataaattaactgtgacttatatttataaattttgctgatgtacgttggtgctaaatcctgcaggtttaacctgagaaatgagagtatatattagtaaaatagagttttatgctatttctcattatctataaggataataagaagtagttttttttgtataaaaattataaagttgaatttataacaattaagaaaaaggttaatatttttccattaataattaataaaagattaataagtatcaaaacttaaatgaatataggattagagttgaagttaattactaactagaaactactaactcctaattataaaaaagggggctttatttatgtcaaataatttaggaaaaggaacaataggaattcatggggggtattcaccaaagtcaggtgagacaagagtgttaccaatttatcaaagtgcaacttacaaatatgatgatccagatacactagaagctttatttgctttaaaatcagaaggacacttatacagtagaatttctaatccaacagttggggcgctagaggataaatatgcaaaattagaagggggagttggagcagtagcaacagcttcaggacaatcagcaatactttatgcagttttaaacctttgtaaagcaggagatcatattatttcagtaacatctttatatggaggaacagttaatttatttaatgttcatttaaagaatttaggaatagaagttagttttgttgaaccagatgcatctgaagaagaaatattatcactagcaaaagaaaatacaaaggctatatatggtgaaacaataggaaatccaggattaaatattttagactttgataagttttcttcagttgctaaaaaaattcaagtgccacttataatagataatacggtagcaacaccatatcattgcaatccatttgaacatggtgcaaatatagttgtacattcaacaacaaagtattcagaaggacatgctcaaacaattggtggaatagtagtagatggaggaaactttgattggactaatggtaagtttaatgactttacaacaccagatccaagttatcatggacttaagtatgttgaaagctttggacaagctgcatatatagtaaagcttagagtaactttattaagagatttaggagcttgtatgagtccatttaatgcttacttaactaacttaggattagaaactttacatttaagaatggaaagacattcaaaaaatgctttagaaatagctcagtggttaactactcaagaaaaggtttcatgggttaactatccattacttgaaggaagtaaatattatgatttagcaaagaaataccttaaaggtggagctagtggtcttttaacatttggagttaagggtggaattgataatgctaaagaatttagtaggagattaaatgtaattgccttagcagtaactttaggagatacaagaagttgtttattacatccagcaactacaagtcatagtcaattaaacgaagaggaattgttagcgagtggagttacaccagatttattaagactttctgtggggatagaagattctaaagatttaattaatgatattagtgaagcattaaaagctatataggtatttgattggaggaatagtaatgactaaagtagctattatgggatatggagtagtaggcagtgggcttattgaattaatagataagaatagagaatacaacagggaaggcaagatactaataactagtatattagttagaaataaagaaaaacattataactcaagtcataatgaggttataactactgatgtagaggagttcttttctattaaaagcgatgttgtaatagaagtaattggtgggttgcatcctgcttatgattatgtaaaaagagcattagctttaggaaagcatgttgttacagctaacaaagatctaatagctacttttggagatgaacttttccaattggcaaaagacaataatgtctcattaaaatttgaagcagctgtagcaggaggtataccaataataaagccattaactgaaagcctttatggtaatggaattagtagtataaaagcaatattaaatggaactacaaattttatattaactaagatggatgggggcaatttatcctatgaagaggctttaagtgaagcacaacagcttggttttgcagaagctaatccagaatcagatgttatgggatatgactcagcaagaaagcttgcaatattatcaagtttagcatttgataaaaagtttaagtggaatgatatatcaatagaggggattactaatatagatacaaatgattttaaatatgctaataaattaaactgtaaaattaagcttatagcagaagcctttaagtgtaaaggtggagtttatacttcagtaaagcctatattagtagataatgaaagtatattagctcaaattaataatgaggtaaatgcggttattttaaatggagatgaaataggagaactattatttgttggtaagggagcaggtaaacttcccacaggaagtgctgtttatagtgatttaaatgatattataaataatagatttaccaaagttgatagcttcaataaagaagaggcaaatgtaataaaatttgctagtaaaacttgcaattgtatattaagagtaaaggctttggataaagaagaagtaataaatagatgtagagaagcttttaataatataaaagttattgataagtctattgatgatgaggttgcaatttttattgaatgtacttcagaagcatacgttgaaaaatttattgaagaaatagaagatgaaatttattatgaagcggctaaaaagttaatagtagcttaaattaattacgataaaatttataagtagtagtatagatagtgataagtggtaagtaacaagtttatgacaaaattttgttgagagatttaaaattgaatttattcagttagtctaaatttgtaatcttaatttcttatcgctatttttattgcaattaaatattttatatttttttattattgaaaaaaagataggcagaaaatgaaatgataatgataattattatcatttacaaagaggtaaatgtatgatatattgtatttaggcttagaaataatttaaggagatgattatatggcaaagatgatgggcccaaggtttaagcagtgcagacgattaggcttaaatgtttgtggacacccaaaagcaatgaatagagctactaaaggcacagcaagaaatgataaaaagctttctgactatggtactcaattattagaaaaacaaagattaagagcttattatgggattatggaaaagcaatttgctaattactttgaaaaagcatctaaatcaagagaattaacagggcatgctttaattaatttattagaatgcagattagataatttagtttatagattaggatttgcaaattcaataagacaggcaagacaaatggttgtacatggtcattttttagttaatggtaaaaaggttgatattccatcattcaatgtttctgttggagatgaaataaaattaagagaaaagtctcaaaagaatgtcatgtttaaagaaaattttgaatcaaatattcttaatgttttaccatatttaagtaaagatgaagctaatttctcgggagttttacaaagatatcctgaaagaacagaggttccaatagaaattaatgaagttttagttgtagagtattattctaaaaactagctagtatcatctttcctttaaggaataaaattttctctaaaaattatatcttatgttatttataagccactgttgaatttaaataagttgtgtgaaaatgaaaatagttaatgtaatgtgcagattacattaactatttttcattttacatattatcaataaaggtctccacttccttcaccttttattaaggctctgatcctttttggcaatattgggtggctactcattaagttattgcaccacacaaaaaagccacgaatatcagcactgttattaatatagtcataaacatcaatttttttgtaaaggtgcttacctgcaaataaggaaaacatagcctcaacgccagaattccctgtaactttttgagctaatctatcacaactatattctctagctcttgaagcagtgctacctataataggtagtacagttgaaaacagtataaataaattataataaaaagtagcatgcttatatttaatatgagctaattcatgagctattataaaattaatagattctaagtcgttatattctctataagcaatttcaaataaatcgctatcaatttcaatgtattgtttacgaattataaaagcagaaaaagcattcataacaccattttgttggattaaaaaggcttcaggaaccctttttagacctaatttatgagaatatttagctatattataataaacttctgggaagttattttcagtaatttttatagcccttgacctgtatttagcataataaagatttactccaaaaggaaaagcaattattgttacaatacctgctagtagtatttgcagttcggttggaaaactacttaaagcagaagtaggagatattactacatttgcatatgaagaagggtctgaaaatgattcttttaatgtatcaggtaatgtattatagttatgtatatttataatacaaagtgctataactgtgattattatagcaaaattaataaatagtaatatcccataccatttcttttcagatttatgtctacagccttcaatttcttccttatttaattcaatattgtcttgttcataaaaactcaagattctcaattcctttcaaaaatttattaaaaagtatatcattaatatacatatatttcacgatttttatgttgtttataatataaattcattaaaaaaacatggtaaactaatttgcttaccatgtttaaataaaattatctttctttattagctatttcagtagtaattctagaaacaaaagcatctaaagccattgcaccttcatcatcattctttctgcttcttacagacacttcgttgttagcagcttctttttcaccaacaactaggatataaggaactctttcaagtctagcttctctgattttataaccaattttttcagttctgtggtcaacttcaactctaacaccattttttcttaaagttctaactacatcatcagcatagtcagcatacttatcagaaagtggaagaactttagcttgaacaggtgacatccatgttgggaaagctccagcatacttttcaattaaagtagcgatagttctttcataacatccaattgaagatctatgaataacgaatggtactttcttttcaccatctttatcgatgtaagtcataccaagtctttcacctaaagcaaagtcaatttgaacagtaattattgtatcttcttttccatgaacatttttagattgaatatcaagttttggtccgtagaatgcagcttcaccttcagcttcaacataatcaattccaagatgatctaatatagttctcatttgattttgagtagcttcccaagcttcagggttatttatatacttttcagtatttgttggatcccacttagagaatctgtaagaaatatcttcagatattcctaaagtttccataacatagtttattaaatcaacaacttctttaaattcgtcttctaattgttctggagtacagattatatgaccttcagataaagtgaattgtctaactctagtaagaccatgcatttctcctgaagcttcttttctaaatagagtagaagtttcagcatatcttattggaagatctctgtaactatgttgttctgcgttataaactgtgaattggaatgggcaagtcattggtcttaaagccataacttcagcatctttttcttcatcacctaatacgaacataccatctttataatggctccagtgtccagaagctacaaataaatcattcttagacataaatggagtcttagttaaaacatagcctctcttttcttcttcatcttcaatccatctttgaagagtttggaataatttagctcccttaggcatgaataatggaagaccttgacctactttttcatcagtagtgaatattccaagttctctacctaatttattatgatctctcttcttagcttcttctaaagcttctaaatgagcatctaaatcagccttctttaagaatgcagttccgtaaattctagaaagcattttattcttttcgtcacctttccagtaagcaccagcacttcttataagcttaatagctttaatgttttttattgacattacgtgcggcccagcgcaaaggtctgtaaaatcaccaattttatagaatgatatgatttcatcttctggaaggtcatttattaattcaactttataaggttcatctttcataagttctaaagcttcgtctcttggaagttcgaatctttctattgaaggattttccttaattatttttttcatttcagcttctattttatctaagtcttcagctgtaaaagctttttctacatcaaaatcatagtagaaaccattagcaattgcaggtcctatagcaattttagcttctgggaataatcttttaactgcagcagcaagtacatgagaaacagtatgtcttacagcatcttttccttcttgagagtcaaaagtgcaaatttctaattcgcaatcttcatttaaaactgttcttaagtcaacaacatttccattaactattccacattgagcaactcttgctaaaccttcactaattgctttagcaacatctaaaactgatgatccattttcaacttctttaatagatccatcttttaaagtaattttaatcattttagtatctcccttcattttaagtgaaattcaaaatcttcgattttgttaattgaacatactcatcgaatttaatagacgatgagattcatttgatattcatttaaaattaagttgtaattttagataagtgttaatatgtatgtgtagcgtcttattgttaacccaaaattgaatttcaacttaatttcaatatgataataaataaatttatgtataaaaaaagctctccatcacttttcttatacaaatatagtacagaaaagggacgagagcattatattcccgcggttccacccttaattgcctaaaaataggcctcttaagtaaacatcgtaacgtgatgcaacggactggattagagtctctcagaggtagtcttcaattaatttcatttaaaaatactttcagctattatattttctctctgcaaatgaagctttaatttactcgtctcttcatcgattttaactttaaaacaactataaatataatttaaaaataatataaattatatcaatccaattttgtacaatcactataggtcaaaatcagaatttcatttaagaataattataattatacaaattaattatgtcaataaactgtttttttataattgagattataaattttaatttagttaatagagattagtcagagagtaggaaagtaaggcttcattttaaattataaaaattttaagaaacagttattttgttaagtaaagattaatataaatatattaattatggatataataatttaatttagggagtggagtttatggctaaatatgtaaatcatgagttttcatctagtgattggcttagatatttttcaaataaatctaaccattggattttaaaatattggcgtaataataaagaaaatttttttaatagatttatgataataggggataaaagattattaataataggggataaagagagaggaaatacttatgaatttttaaaacctcgagaggagtcttttattcaattagatatggaaatctagagggaaaatatattgaaattattttacaaaagttgtaaaatggatttatggaaatgcagatgtggcgaaattggcagacgcactagacttaggatctagcgccataggcgtatgggttcgactcccttcatctgcaccattaaaaaaataaaaaataaaaaagtataaaaaagtagttgacaagatattaataagattatataatcttaagtgtagaaacgagctcgacagaatcgagtgaaaatatttatgcgggtatcgtatatcggtaatactccagccttccaagctggaaaggtgggttcgattcccactacccgctccaggtaagactgtgtttacacagtcttttttgtttttgtttgtttaatttatatcgttacataggaatatgtttattagataagcatattaaatacaggtaatatagatattagtagagagtaaatataaaaaaattgccttcaaaattatcatatataataattttgaaggcgattctatatgcttaaatagtgttttatattcaatataattttatagtacttcagttaaacggtctaaagcaagctcttctaaagtttctatgctgtatttaacacaccccataagtgtatagattatatcatcgcgtttatagccttctttatatctctttaagttctttaataatctttttaaggaattattatgaacacctaaaatttgagaaatctcctttggagagtaatattccttttgaagagtattgtacaatttattttgcatttcgattttatattgaagatctacaaattggttttgatgtggaccattttttcctcggtgatgataagcgcataaatacttataatttaactcaatatcaaaaccaccctcgcttctatgaactatatgatgaacatcagctttgtttccacatatctcacaattgtacaatagattgccccctttattttttatgaatataatataagaaatttatattgatattatattctaaatagtgttaaatatcaaatttacataatgaaaaatgttactattgattatttttaccataaagtggtatatttaatatatattacattatattatattatatttaaatttatgaaagaaggtgattatatgagagaaaaatataattcttttgagtattggaaaaatattattgttgagaatagaactattagaggacatatatttatgaatgaattaccaactgagaagagtgtctatatgcatactttaatttattctagaggaaatggattgaataatatatggagctattttccgaatattaaggcatttatagggtatgtacaatattcatttttacaagaagccttctatatatggataaattgcaaagatgaatctatcgcttatataccattaatatctgttgaagaagtaataagagatggtgaagctagtaaaaagattactaaagcagaagctgataagatgagaaaagatataaataaagtgaagagatgttgggatttaccttctaataaagcattgatagaaatgaaaaaatttataagagagtttaatagaaattggtatggggatagtaaagagtttttatatatgaagttatttgataaaccagaagacttaggtaaatttgttttagaatctaagtatatggcaagtagtgaagaagagtttaaaagtaagactaatgaggatttaacaacatggatagatttatgtcgtcgttctactaaggataaagaagcaggggaaattttcaagaaaatattacaaaagagtctcacagaagttatctaaaatttattgacaatataatttgtattggttataattatattgtcaattatgcgggtatcgtatatcggtaatactccagccttccaagctggaaaggtgggttcgattcccactacccgctccattttatgcgctattagctcagttggtagagcacctgactcttaatcagggtgtccccggttcgaacccgtgatggcgcaccaaaaaaagaagtaacttttgttacttcttttttattgattttggttggactttgttttacagttgacagtgatatatcaacttgttaatatgtataagaaatgtattttaaaaatataaaggttaaatttatgagtaataaagttatattagaaaaataaaactttaggatcatatttaaaaattaatatcttatcaagagtggtggagggactggccctgtgaaacccagcaacctattagcagttaggagctattagttagtagttgatataaaaacttaaatagtttttatattttagaaattcagtggaattttatcgataactattaactaaaaactcaaaactattaatgatggtgctaaatcctgatagatgagaaattataagtagttttgataattaagcttctgagtttctcgggggctttttttttatttgagtaaaataccaaggaggagagagagatgaataaaaaaggaaatggatgggcattattaccattgttagtttttataatagtctatgtatcatcagctttattagcaaaagatttttatgcagtatcagtaattgtaccatttttagctgcaacattagttgcattattaatgaatagaaaagttaaatttgatgaaaaagttgaaattttttgtaagggtgctgggaatagcaatataatattgatggtgttaatatttattttagctggggcatttgcacaagtagctaaatctatgggagctgttgattcaactgtaaatttagggttatcaatacttccaagtaatataatgattacaggaatatttgtaattgcttgttttatttcattatcagttggaacatcaatgggtactatagttgcattagttccaatagctgttggagttgcagaaaaaacaggaatagttacagcaattgcagttgcagcagtggtttgtggagcgatgtttggagataacttatcaatgatttcagatacgactatagcagcaacaagaactcaaggttgtgagatgaaagataagtttaaaatgaattttaaaattgtgctacctgcagctgtaattacagctttaatttttattttaataacaagaaattcaggggtaactagtgttgaagcattagagtatagtttaataaaaatagttccttatatagctgttattgtaggagctttagtaggattaaatgttattgtagttttattaggtggaacagtaatagcaggtattattggatttgcaacaggaagttttgatatattagggttttttggagcaattgctgatggaataggtggaatgagtgaacttattataatatctattttgattgccggaactattgaaattataaaatataatggtggaatagattttattattaataaggggctaagaggttttaagagtaaaatgggtgcagaatttggaattgcagctttagttagtttagtagatatttgcacagcaaataatactgtagcaattgttactgtaggacctatagctaaggatatatcagatgaagtagggttagagcctaagagagttgcaggaattatggacatgttttcttgtgtatttcaaggggtaattccttatggtgcacaacttatatcagcagctggacttgctgcactttcaccatttgcaataatgaaatatttattttatccgtatttaatgggggtttcagcaattattgcaatagcatggtatcatagaaaaaaggcaaaataaattaagaaataatatattgattagcaaatattgtgctaaaacaattaaatacataattttaaaaagatgatataaaaatagtagtgtaggattagatatatttcctacactactatttttaatttaaaatattatttattcttttcaattagacaaattgattgtgatgatattccaaggcctttacctgtaaatccaaggccttcttcagttgttgctttaacgtttatttgctctattgatatgttcaaagcagtggctatattttcgcgcatattaggtatatgaggtgccatttttggcttttgagcaattattgtagtatcaatatttccaattgtataattatgttcatgtaatagattgccaacatgttttaataattcaatactagaaatccctttgtattttaaatcagtatcaggaaaatgtttaccaatatctcctaatgctgaagctccaagtaaagaatccattattgcgtgtacaagtacatcagcatctgaatgaccaagtaaacctaattcataaggtatttttactccgcctaaaattaaatctctattttctactaatttatgtacgtcatatcccattcctattctcattaaatcacctcattaattttttatcttatagcttagtcataatagctattatattcaataagcttagcaagcaggtgaaattagaacttcacctgcaactataaaagttccatatatatatattaacataaagatgtattttgaaaataaaaatgggataataaaattaatagttcgaagtttttctactattataagaagcttgttttttgtttttattatgattgattctgaatggaaaaattcttaatagcttagagtaaagcctatataataataaaagagatttagagttaattctttttcttttgaatatgaaatcgatataaatcacattatctttattatatttcataaactccccccatatactttacattaaaaagtattaatgttttaagtgcttatgttataatatatgtagaaaaaatcatatatgtacaaaattagaaaaataaaaaaagaaatttaatatagaggtgaaattgttgggaaagttaagaaaagttgttggaatattactaatacttataggtgttggaataattggaaatgtagcgtataagaaaatagttacataccataagcaaaatgaattattggaagcctttgaaagtcaattagcagaaggagataatgagaatgataaggaagaagtaaatttagattcaataaatggatatacacctatagctattatagagattccttcaattaaactaaaacagcctgttgtggaaggaataactgaagatgtaattaaatattttttaggaaagttcccagagtcaacaatgccaggggaagtagggaattttgcagttgcgggacatagagtttctgattttacagatgcatttataaatttatataaagtaaaaccgggtgataatgtaattgttactacaaaagatggtaaatatacatatgaagttgaagaaagttttattgtagacccagatcaagttgaggtcttagaaagtgcagattatgaaaaaattacattaataacatgtacaataggatcaaagagaagagtaatagtaacaggaaaacttattgagaaaaatcaggcgtaagggtagggggcgtaaatggacaagtttcaaaagaataaatatcgattttcatcaacacagccattgatattgattggtaatgatataatagaatcaagaaatgaacaagtaaatcagcttgtatcagaattaataaaatataaagtgcttttaagagatctattaatttcagaagtagattattcccaaagaaatgaattattaactatagcgatgtttattataaataattttgagttatatgatacttttgtaaaagatcaagatgtaccaattgatattttacataggtttacaagagtagataagaagttcctacagaaatatagagagtatatagttgcatatacattgatatttggaaatgaagattataaaaacattcaggattatgtacaaatagctgaaaatagtatagaagatgaagaggaaaagagcaaaaaggaaattatagagtatgaagaaaaaataggtgttaatggtattgtaatagggaaaaataaaaagaatgcaattattcttacatctattggtgagtttaagaaagttaaattgaatcaagatgtaatgaatggagaagaggttaaggcaaatgaaaagaaaactctaaaggattttaaaatatatatatcaattgtattgatatttttagtagttttttcagtttctatggtgtataagtataacaatgttattagaaccattgtcgttgaaacaacttcatcaattagattagagattaatggatttaacagagtgctgagtatttcatcatcaacagaaaagggacagttattagtggaggaaactaatctattagatcaaaagcttgacagagcaatatataaaattatagaatatgctaatgaaaatgaaatggtaaaatcaacaggaattacagtaacaataacaggtaaagaattaaagcataattccttagttgaaacggaagattatatttataagaaaaacttaaaggtcaggtttaataattcaggggtagaacataaggttaattaattatggataaatggacctccggaatccaaaatttggacccgggggtcttagattttccaaatatattatataaggaaggtacatatgcaacaaaagtcaataaaaaataaaaatgtaattgttcataatgatagaggagatactgttaggttaaacaagtatataagtgaatcgggcttttgttcaagaagagaagccgataagttaattgagagtggtttagttactattgatggagttaaagctgaaatgggaactaaggtttcaaagggacaaaaggttaaggttaatggaaaattaatttctaaagaagaagaattggtttatatagtacttaataaacctgtaggaataacttgtacaactgagcataaggtaaaagggaatattgttgattttgtaaatcataaaaagagaatatttccaataggaagattagacaaagattcacaaggattaatattaatgactaatgatggagatgtagttaataaaatattaagagctgggaataatcatgaaaaagagtacatagtaacagttaataagcctattaatgaagaatttgttagaagaatgagcaatgggattagaattttagggcaggttacaaaaaaatgttatgttaagaaagaaggacgtaatacatttaggataatattaactcaaggactaaacagacagataagaagaatgtgcgaagttttaggttatgaagttgtaaaacttaaaagggttagaattatgaatataaatttagacgatttgaagataggaaaatggagagatcttacttataaagaacttaaagagttaaattctcttatttcaacatcaggcaaaactaaagaagttgatgaagaggaataatagattaaataatagagatttaataaaaagaatggtaaagtcatagcggaatgctatggcttattttttgtaaaaaattatccacagcatttaaattgagatatagaaatttgaaaagatatccacagataataaagggaaagtgataggtaaataaattaatagattgaaaatatctgttttaaattataaatgtgaattttataatttaaaatgaataaaaataataaaagaaaatgatgattaatgatgtaaattaaaaaaaatggaagtgaggttataaaaaaataaattaataataatagttaaatttataaaagtgattttataaattctaatgtttgtaaaaaaataatagtttaaataaaatgttaataagttgataaaaattaaatgtttaattttaagtatataaaaataaaaaaatgataaaatagatataaagaattaggtaataaaaaataatttgataatatttataaagatatgcataaaataattttatgaaaaaaattataaaattaacaaaaaatagaggttacgcacataatcaacagggggttgtggataacttgtttaaaatatgttgatatatatgttaataattatcaacaatattgtagataataataaaaagagcgtgagtattatcgaaataaaaggagggtcattttatgaagtgcctaaaaatgtggattttagtaatattaatgttactaacagtagtcgcgagttatccacaggccatgttgaaaactgaatacttaaatgaggataatataagtgttgaggttgtggataaagtatataagtcaaaaaataattatttggatattaatgtgattatcccgcaaataaaaggcttaagtaatgataaaaaggaagctgaaattaatgataagattgtaaagtggacagaaaaatggattgatgaagcaaaaagtattgctgatgaatatttcaaggattatccttcaccattaatttcttatcaattatatgcaagatataaagtaactaataattcagatattataagtttttatatagattattatcaatttacaggtggggctcatgggattaccaatagggtagcatataatatagattcggtaacaggaaatgaattgcagttaaaggatatttttaaaagtgattttccttataaggatatattaaataaagaaattaacagacaaataagtaaagatccagatagatattttcctgggaaagatggatttaatgggataaatgataatcaaaccttttatattaaaaatggtaatattatagtttattttggattatatgaaattgcaccatatgcatcaggtatatctgaatttcttatacctaataatattatacaaaataatgttaattatggtaagatttaaatatgaatttaaaataaacgaggagtttgctaatggaacatatagaaataatctttaaaaaacaaaagaaattttttagcactggtaaaaccatagatattaattatagaattcaaaatttgaaaaagttaaaaaatataattaaaagcaatgaagataaaatattagaggcattaaaaaaggatttgggaaaatcaggatttgaaggatatgccacagaaattgggattgtatatgatgatattaatcttcatataaagaacgttagaaagtgggcaaaagaggagaaaagaaagtcgcctataatttactatccgtctaaaagctatgtttataaggaaccttatggagtaacacttattataggaccatttaattatccttttcaattagttatatcacccttaataggggctatttctgctggaaatactgcaataataaaaccatcagaaaatactaagaatgtagccttgttacttgaaaaaatgattaatgaaaactttaatgaagcatatttaaaggttgtaaacccactaggtggaaaagaaatagtatctactcttttagacttaccattcgattatatattttttacaggaagtgtgagagtaggaaaaatagttatggaaaaggctgcaaaatatttaacgcctatgacactagaacttggtggaaaaagtccatgtatagttgattcagatgcaaaattaaatttagcagctaagagaattgtgtggggaaaattcttaaatgcaggtcaaacttgtgtagcacctgactatttgtgtgtacataaatcagtagcagaaaagttattaaagttaatagttgatgaaatacataaacagtttggaagtaatattagattaagcgaggattatcccagagttgttaataaaagctccttagagagattaatgagctatttaatggatggcaaaatttattttggtggaaatattgataaagatgatttgtatatggaaccaactataataactaagccagatcttaattctcctcttatgactgatgaaatttttggaccaattttaccagtattaatttatgaagatttaaataaggtagttgaatttattaataatagagagaagccattagctttatattatttttcagaaaataaaaagaaaattaagcatattttaagggtaacgacttctgggggagttactataaatgatactattattcatgttgctaattctaatttaccttttggtggggttggaaatagtggagttggtaaatatcatggaagagaaagttttgaaacattcacacataacagagctgtaatggatagaggaacatttgcagaatttaatgtaaggtttgcgccttataaaaataaattaaaattagtaaagaaaataatgaaatagtattataatttcacaattgtgaaaaagcactcatataataaaccatagcactacatggagtggaattttgtgatatacgcgctaattttagctgggggaaaaggtacaaggctatatcctttatcaagagcaaatcaacctaaacaatttttaaaggttattaataataaaagctttttagtaaatactgttgaaagaattactcctttaattaagaaggacaatatttatgtagtaactaaccaagattatttggataaaataagaggtgagttatctgacgttaattctgaaaatatatttactgagcctgaaaataaggaaactgctttatatatctaaataggttctaaaccggtactatgtagtaccacctttataaaaaataccggtactatctagtacctatcatggtactattaaaaaccttatcggtactacctaataccgtataggtactaaatagtagctaacaaagaactaaatataaaaaactaaaaataaataactatatataacaacaactaataactgccgtggttgttataatggtatatagatattagtttatattgatagatacatcactatatggtataatggtaatagataaataagtatttaggaggaattaaaatggcggttgttaacagaaagagaatatgcacttcaatatcatttgaacattatgataacttaatgaaagtatgtgaagataacaaacagaaacaatcagcagttttagaaatagcattagatttattaaagaaggaaatggaaaataaaaacttatcagatataattcaatatattaataatagtaacaagtagaaaaaacttgttactattttttttatttatttttaaaaaggtattgaaagatacatcactttatgataatataattacagaaggtaagtgatgtatcttgtatgatagatacataataagcgaagggggtataaaaaatgagtttcaatagtaactactttaaacaaactaacaacatattcaatttaaaattaaaacctaatcaattcacaatattatcatatctaatcagaatggctaacgaagccgaaaattgttacccttcaatgaacaacatttctgaaatgtgttgtgttagtaagtcaacagtagtaaaaactattgaagaacttgaacagattggatatataacagtaaatattgataatacatacaacgtttatacaattaactatgatgtaattgaaagcactaataacagaccagaaaatgtaaaaaaaactagaactaaaaaagtatctagtaaaccagaagtaaaagaagttaagccggttgatagtaacggcaatgctccagtagatggacaaatacattttacagaagttaaaacaattgaagaaagattaatagaagaaactggagttacagaagaaagagttaaacaagctattgaatatgcagaatttaaaaatgcaaaagatgtatttgcatatgctagagatacaataaagaataattgggatatgccaaaaacaatagatgaaattattaatagaacaattaaaacaactaaattcgtagaacattgtccagctagagaaggtttagaagaaatttataattcattagaaaataaattgttaggttgggataaacgaatcgccttcagaaccagaaccgccttcagagccagaatcgccttcagagccagaaccgccttcagagccagaaccaccttcagaaccagaaccaccttcagaaccagaaccgccttcagagccagaaccgccttcagagccagaaccactttcagaaccagaaccgccttcagagccagaatcgccttcagagccagaaccgccttcagagccagaaccgccttcagaaccagaatcgccttcagaaccagaaccgccttcagagccagaatcgccttcagagccaggaccaccttcagaaccagaaccaccattagagctagaactactgttagagttattatttggtctgtttggcttagatgttgttatatcttcgtcattttcatcatcactataataaatatcattattttcattattataagtatcaatttcaacttcagttggttcttctactataacttcttcaggaggaatataagcttctatctcttcatccaatatagcctttttttcccttaatacgatagaattatttgtagttgcctttgtttgaataaaatcaagtgagaaaattaaaattgtagcaactagcaaaataacaataaacatattttgaaatttttcagatttaaagttcataaagtatgttctccttatatgataaataatagttttacataaataatattctataaaatgtaaaaagaatcctctaaattagtaaaaaaaatgttgcttaagaacaaatgttctgatattattaaactaataattgaacatttgttcggaggtgcggtatgaaagagaatagggcaatatttgtaaaggttaattataagaatataggggaattaaatagttttatttatgatagtatgaatggagtaaatagaaataaagataaatatgtaatgtgtgctggaaaatatagcaaagacggttggacgatggtttttaaagctaaaagcataagtgaagctgaggagttattaaatattaattcagccaaaagagaatcgcatagaaagaaagaattaattaatacacaattaatggataaagagagggtattgataccttcatggatgaataataactaattcattatttacataaagaatgcataataatttatatattataataaatcaaagtagatttacgcttaattaaggtataaaataaaattaaggaatatataaattggagtgagatgatttggataaaaaggatatgcccataggctttttagattcaggtgttggtggactaagtgtgatgagagaagctattaaaataatgcctaatgaaaattatatatattttggagattcaaaaaatgctccatatggaataaaacctacaaaggaaataagggatctaacatttaatgtagtagactttttaattgataagggaattaagggattggttgtagcttgtaatacggcaactagtgcagcagtaagtgaattaagaaaaacatatcctgatttacctttagtaggtatagagccagctataaagccagctgttgagatgaataaggatggtaaaatattaataatggcaactcctatgacaattaaacaagaaaagtttaatttattacttaataaatacaaagacaaggcagatatagttccaataccatgtgcagggcttatggagtttatagaagaaggaatattaagtggaaatcaattagaagagtatttaagggaaaagttgtgtatatataaaagcgaggaaatagcatcaatagttttaggatgtacacattatccgtttgttaaagatacaatagaaaaagttgtaggtagtgaaattgatattatagatggtggagaaggaactgctagagaaataaaacgaagattaaaagaaaaagatttattaacccataggactactaaaggagaaatatcaatttataattcattagaagaacaaaaggtaatagagttaagtttaaagttaatagaaaaaaaatagaaaacgccaagaggcgtttttttattgtagaaataaatgtaaaaaataattgttaaatagttgacaatattctgaaaattgtatatattattaataaagaaagaattttcagaaaatttagggggattaataatatgagtatgaatattaaagttaaagatttattaggtgataattatgctatagaagatgctattttattaagagagatagtaaagaataacttagatcaagaagtaattttagattttgctgggtatgatagaataccatcaacatttttaataaatttatttagtgatttaatatataaatttggaagagactatatttttaaacaaattgttgttaaaaatttatcaaactatagagattattcaagagtagtattaggtactgcatttcaacaataaaaaatataaccatatctaaataatagagaataaattcatatcataaatatttatcatatatttagcttcgattatcgaggctttttttcttaagtgaaagtccaaattttaactgatactctaaatcatatatttagttagtagaagttaccgttttattaataaatatatataaagtagaattcctctaaaaatttaagaaaatttgaataaaagattgaattagtatattaaaatatgataataataaattataccagaaaatgaaagtgaggtaataaaatgaaaaaccctatagttactatagaaatggaaaatggagatataatgaaagctgagttatatccagaaatagcacctaacacagtaaagaactttgttgatttaataaatagaggattttatgatggattaatattccatagagtaatacctggatttatgattcaaggtggatgtccagaaggaatgggaattggaggacctggatatagcattaagggagaattctcaagaaatggatttaaaaatgacttaaagcacacaaagggtgttttatcaatggctagagcaatgcatccagattcagcaggaagtcaattctttattatggtagaaaatgcaccgcatttagacggtcaatatgcttcatttggaaaaataatagaaggattagaagttgctgataagatagtaaatactaaaagagattatagtgacaaaccatatgaagatcaagttatgaaaaaagtaacagtagatacttttggagaaaattttggagaacctgaaataatagaagattaatatttaatttcatgttaaagtaataggctgtatcatttttgatgcagccttaaattaaagttttgtaagtataacggggtgattgagatgattaataataataagtgtatattagtatatggtttatctaatatagacttagagtatatgaaaaagcttaactataaaataattgaaataactccagaaatgtgcgaaatgactttaagagatatattatcaggattaagattagatatttttaataatagtccgcttaaagaaaaagtaatactttataataatttaacagaaattgaagtgaaaaaagtaataaaatatactcgtgactatatcaaagatggaatattagctgtagtaacagagcaatctattaattggaaagtaaattatttaatgaaacatttaaagaatgaaaaggattggtattcaaaggtaagaaaggaaatcaaggatgagtagagttggcgaaaaaataaaagaagctagattaaagtcaggaatgactcaaaaggcacttggtaaaaaattaggtgtagcagaaaaatttataaatgacgtggaaacaggtagaaaaattgtacaagaatcatttatagaaaaggcagcaaaaatattaaatacagatttaaatgatgtaagtatggttgtaactgatgaagcattaatggaagaaagaaaaagttatgccgaaagcaataagaaacctactaaaatagaaacaaatgaagtttgggataatgcattttctacggtattgaaaaatgttcctatttatgattataatttaaaaaatattttaggaaaaatagaattgcctatacattcaaataaggtagaaggatatcatcaagataaagtaatgtatttacaaattcaggataatgagatgtctggttttagaatgatggaaggcgatttagcatttgctcatttagttaaggaaataagtaataatggaatatttttagtggattataaaggaaaaagaagaataagacaaataaaaagtcttggaaattctaaattacttttagtaagtaacgggggagctctaatgactgaaactgttgaaagtaaagaaattgcagtcatcgcaaagatagaaagaattgaaataagattatagaaaagtgccaagaggcacttttttttattatataaatagtagaagtttaccaataaaaagtaatgtacatattaatttggggacaatgtggataagttaattagacctgtgcataactttgcaattaatgttaagtaaattttttttattatattcaggcagatttaaatgatttagtttttttatagaacaattaataaaagtacttttttcaatgtattagttcaaatatatggagttaaacatatatttataataggaattattatgaggtggtaaatatagaaagtaataaaaataatttgggtttattaaaaaatatacctaaatcaatattatcaaagtttaacatatcgaataattttttagcaactagtaatgatgctgaaattgaggtaagtataatttcaggtagttctccaagtgaaatttcccaaattgtagagaatttaggtggaaaatatactgatttaggatatggatatgggatagtattgattcctatagagaatattattgctttagcaacaagtccccaaattcaatatattgaattgccaaaaagtttatatacaaatgattatgaaagtaatagggcttcttgtataactcaaataaattctggagatttgaaagggcagggtgttttagttggatttattgatacaggaatagattatactcatcctgcattcagaaattctgacggaacaactagaatagaatatatatatgatttagatgatgatggaaaaatatatgataaggctaaaattaatgaggcacttcagtcatctaatccatattcaatagttagttcaactgatgttaatggacatgggacacatgttgcaggaatagcatgtgctgggggaaatatagatgtgaaatattatggtgtagcaccagaaagttcaatagtaatggttaaggttgctagaagtagatttgcattgagtactcaaataatgcgaggaataaaatttcttattgataaaggaaaagagctaaatatgccattagctataaatatgagcttaagtactaatgatggagctcataatggaagtagtttacttgagcaatatatttcaacagtatctgctactcagagagtaactatagttattgcagcaggtaatgaaggggaagctgcacatcatgtaggaggaacattagaagatttaaatgaaatatattttaatatttcatcagatgaatctatagttataataaacttatataagtcaatattaccagaagtaagcatagaattgttttgtccatgtggatttagtacaggagaattaatattaaacgaaggatttaatgaaggcacgataggaagctctagatattccatatatttaactggaccaaagccttttgatgtaagtggagaaattggaattgtgttaactggtgttaataactttgtatcatcaggtcagtggaggataactttaagaaagttgaatgaataccatggaaaatttgatatgtggttaccaatttcggaggggttaaatattaatacaaaatttttaaatccggttgtttataatacattaggaattccagctacagttagaaatgtgatatcagttggtagttataattacttggttaatactatctcgccatttagtggtagaggagaaaagtataatgggaaatatataaaaccagatatagttgcaccaggtgaaggaatttattcaactatacctaatagaggatttgataaaaaaacaggtacatctatggcgacaccacaagttactggagctgctgctcttatgatgcaatggggtgtagttaatagaaatgatccatatttatatggagagagattaaaatattttttgattacaggagcaaaaaaaggaagacgagatatacaatatccagatgcagcatggggatatggagagctttgtttaagagagagtattaatttagtatctcaaacgttgggcttaggatttagaaatatttgtatcaatgatagacaagaaaataaatcacttaaaggtgtagctggaatagatgttgactatgatacagaaagtacagagaaagtctttattttagctgaggtttcagatgcagatgctcttaaaaatatattaaaaataccagaagtttcaggcgtaatgatatcaacaaattttgcagtaataattaccccggctaataagattaatgaaataagtgaagcagttgtaaggatagttaatatggaggtttctactatattaacattgaatgagctttcgccagtggaagctagtggagctcctgtgtttaataacaacccatacctaaggcttaatggaaaaggtgtattggtagggataatggatactggaatagattatctaaataaagaatttcaaagagaagatgatactacaagaattttaagaatatgggatcaaactattcagggagataaagaaatatatggattaaaatatggaactgaatatacagagcaagaaataaataaggctataaatttacagactacaggtggtgatccatatagtatagtcccatctaaggatgatataggacatggaactagggtaagtggaattattggaggaagaggaataaatcctgatttaaaaggagctgcacctgactgtcagtttattattgttaaattagctagatcaactaaggtagaacttgatgctgctcttattgataaaacagatgtaccttcatatagtccatggagtgcactattagcattaagatatatagtttcagttgcaagggcattagataagcctgtagttgtatttataccactgggaagtagtatggggtctcatacaggtaatggaattattgaatcatccatagataatttttcgagtcaggcggcaactgtaattgttgttcctacaggcaatcaaggtaatacagatactcatacagaaggtgtaattgaaaaagttggagatgtaaaagatatagaaataagaattggcgaaaaacaaaaaaatttaccgatagaaatatggatagataaaccaaatagagttaagctagctattatatcgcctacgggggaaatcatagataatcttgagtctaaaaatacaaataatgataggattaagtttttatatgaagaaactgaaatgatagtaaattttacttctcccgaattgacaactggagactcacttatttttataagggcttataatttaagggctggaatctggaaatttagattaacggggcaatatatagtagaaggtaaatactatgcctggataccgcaaagagagcttatagataatgaaactaagtttttaaatcctactgaatatacaactattacattaccaagtacatcaagaggagcgatttcagtatcgtattataatcaaaataataatgcaattttatcagagtccagtagagggtatacaagagatgatcgtataaagccagatatagcagctggaggaagtagagctttagttactaacccaggaggtacgacttcactaatgactggatcttcagttgctggggcagttgtttcaggatgttgtgcacttattcttcaatgggcagttactgatggaaattatccagatatatattcaacacagataagatcttatattataagtggtgctaaaggaagaccgggagatgtttatcctaacagagattggggatatgggatgtttgatttacaaggtatatttgataggataagagaaacctatacaccgagatctgatgtaggatttcaagaatatagcgttaataatctatttattagaaaacctactgatttataataatcactaaatataatttaaaagcatattaatatagtgaattaatttatgtaggagtaatatatgccagaaaagggtggtttaaagttacaatgctttgttggagatacctacattcctatagaaggaataaaagctacattagtaccttcacagggatcaagtggggaaagtaaggaaatggagcttacaactaattcgtctggagaatcgcaagtaatagaattatcagcaccattattagaatattcagagcaaccaacaggaaatataccatatagtctttatgatttaagaatagaaagacaaggctttcaatcattagttgttaatggaatacaaatatttcctggagaaattgcaattcaacaatgtaatttagttgaagaatcaaggaggagtgggagtagggcagatgtgataaatattcaacctaatactttgaatggaaattatccatcaaaaattcctgaagaggttgataaaccattaccacctccaacaagtggagtagttttgccaaaaccggttgttccagaatttattacagttcatgcggggggaccaaataatacaagtgcaccaaattacacagtagcttataaggattatataaaaaatgtagcttcttgtgagatttattcaacatggccagaaagtaccattagagctaatgtatatgcaattatatcatttacattaaataggatttatacagaatggtatagaggaaaagggaaaaattacgatataactaattcaacagcttatgatcatgcatttaactatggaagaaatttatatgagagtataagtgttattgtagatgatatattttctacttatatacgaagatttggtagaaaacaacctttattaacacaatattgtgatggtaaaaatgttacatgtccagggtggatgactcaatggggaagtaagtatatgggagatgaaggaaaaactccatatgaaatattaacatcgttttatggaagtgatattgaactagttactgctgaagttgttgaaggaagtccaagttcttatccaggatatgatttgacagttggatctagtggagatgaggtagaaactattcaagaacaattaaatagaatagctcaaaactatccattaatacctaaatcagcagttgatggcgtttatggagataaaacaaaagaggctgtaacagtatttcaaggtgttttcaatttaccacaaacaggtgttgtagactatgcgacttggtataaaatttcggatgtgtatgttggtgttactaaaatagcagagcttagatcaggttgtaaaccaaggctatttataccaccagtatcatttgatattataaattcaaatgagataccaagatttaattattttggtgattgataaaaaaagtgatatgtatttataggttagcatttaccaattacaaattttgttattgataaatgctaacctattattttaggtattaagttctgatttgtttttatgataaaagaaaatacattgtgtaataaatattaagcttaaaacaccaaaaagaggatataaagtagatattaaatttgagaatcctatttgtgatattggtaaggcaacagctaatacaatgaatattcctttcttaaattttatattaaatgattgttcaagggttttacttattgagtatacgtcagatacttcagtagaaaacatttcaagccaaattataactaaaagtaatgcttgaattacacttccaaatctttgagcaactaagagtaaaggaatctctaattcatatatataaggttggttagctagcaataataagttaatagcacctgatagtaaggttaatcctaaagctccaaatgcaattccatataccatggtttttgaactttttgtttcgttacttaaaggtactagaacaccagaacaacaaagaatgttatagcctgcataaaggatagtagaaactacaacaccttttttaggtggttcaaatgaagatataaattgaaaagatatagaatctttacaaaataaaaaatataaaattattataagtgttattgttcctaatagtgacggaacgataaatgagtttacttcaataagtccatcagtacctcttaataaaaaaatagaggcaaggcataacattattaatgatccaactattttaggaataccaaaaaattgattaatcaaagcaccactaccagctaggattattgaagcacttgaaataagataaaaagttgtaattacgccagtgagtttacctaataaattaggacttattatttttagaacatcactataggagtttagactatatttaatacttattttagctattattgatcccattaatatataaaatgctccacagaaaagtattccgaaaaagctagtcaaaccaaatgaagtaaaaaattgagtaatttctttacctgatgcaagtccagctcctacaatggttcctataaaaacaactgcaatttgaaaaattttagtaaaatctttcttcacgcacatccctccaatatatttctaatatctaatatataaggattacagtataattattctttttatttgtgaataaggtataagttattaggaaaaataaatttaaaagcagaataattgtaaggagattaatatgattagcattaaaaggattttaaatgggatattaattttatcaattagtgtactaattagttgttcaaacgtaaatgaaaataaagaagaaactttagatttatttgatgtttttaaaggaaagaacttagcaaccgattatttaattaatataagaaatggggatataaatagtgcaacagagttttgtgacaaggatctcatagatggtaccattaacttgtcagaaggagtatcgaatattaccggttttcagcttgataaaaccgtagcaagtagtgagtttgcatactatatatttaatgtaattagagattcgaatattgaacctaaaagtgatttggagcaatatacaataagggtaaatagaaatggggataactatattattggagatataaaatcaaaatcacaaagagagttatacataaaaaataatgcaattagaataattggggataagggtggaaagagtaacttggttattagtttaaataatatacctaaagatacctatttaagtaaaaataaaatgatgctttataaagaaaaagtacctaataatagttttggaaaggttgttttaggttttacaggcaagaagattgctatttcaactatagatgataaaaattcatacatttgtattgcgtatattgatgatactttaatgagcggaggaacagatatagttgatttaaatagtgattctcagaattcacagttaggtggggaactacaagagacattagaaaaaccgattgctagtaagattatatctgtagatttgattaataattcccaaatagatgattttatattttctaaagaagatgataatttagctgtaaattttaaaaaccaaaatggattaagcagtttaaatatatataaggctgaagatggaaaacctgtagatacaaaatttaatgagatgtttaatctagacatatataatattaaagctgaatattttgatgatgataaggtgatttttgatgtatttaaaagtgattcaactaatgatgagacaacaggaaagtatagtctggatttaaagagcaatgaaatgattaaattgtaataagttaataagtattttataataaagaaaaacataaaaagaggttaatgcaattagcatggcctctattttaaattatattgaatatataatttatagattttaaggagaaaaattatgaaggaatggaatggaaaaaggtatcacagcttaaattatttcctaagaaataaattcggtgaaaaaatatataaaatatcattagatggaggttttacttgtcctaatagagatggaaaagtatctaaaggtggttgtactttttgtagtgcaagaggatcaggagattatgctggtagcagaatgttatctataagtgagcagtttgaagacagaaaggtaatgatggagaagaaatggaaagatggaaagtatattgcttatttccaagcttatacaaatacctatgctcctgttgaagaattaagaagaaaatatgatgaggcattagctcaaaaaaatgttgttgctttatcaatagcaacaagaccagattgcttggataaagatgttttagattatcttgaagaacttaataaaaaaacttatctttgggttgagttaggattacaaactataaatgatgatactgctcgtaattttaacagaggatatgatttagaggtatttgataaaagtataaaagaattacaaaaaagaggcattgaagttgtagttcatactatttttgggcttccaggcgaaacaaaggaagacatgctaaagactgtagactatgttgctcacagtggggcacaaggagttaaattccacttattgcatttaatggaaggtactaaaatggtacagcaatatgaaagtggtgaattagaactcttaagcaaggaagattatatagatttaatttgtaaaggtattgcgatgataccagaggaaatggttgtacataggttgactggagatgctccgagagcaagcttaattggacctatgtggagtttgaaaaaatgggaagtattaaatgacattgataaagcgcttgtagataatgatatttggcaaggaaaagattttaagtaagttatagaataatatagagcgactgtgtgaattgttttttgcaacagtcgctttttaatttataatatattatggaaacatttactacattatattggtaggtgtaagttttaccaataaaattgaaagtttatattcttatattatggaacaaagtagaatgagcaattgtcaaatgaataggaaaggagcgaaagttttggaagcttcgatgtatgattatagtaaagatcagttgataatggaagtaaaaagagcaaaagatggagataaagaagcattttgtgctctaataagaataaataaaatagcagtatatagagtatctaagtctatattaaataatgaagaagatgtagaggatgctgttagtgaagctatattaaaagcatataaaaatatacatgctttaaaggatgaagctttttttaaaacctggttaataagaatagttattaatgaaagtaataatatatataaaaaaagatcgagagaaatagctgtagataaggagcattttaaaaatataagggttgaggatacttataaggatttaactttatataatgcaattaatttattagatgatgacttaagaacaactacaatattattctattttgaagacatgaaatacaaagatatagcaaagattttaaatgtaaaggaaggaactataaaatctaggttatctagagcaaaagaaaagttgcataagattttaaaggaggagcttcatggataattttgatgaatatttaaagaataaaggtcatatagaagataaagaatttattttgccaaaatcatttgatgataagattgaagaaactcttggaacgttagataagataaatttagagaaaaggaaaagttggtatagtaataaaaagatttgggctacagcggcatgttttgcatttatttgcctaacagcaatatcgataaatagtaatattaatttaaataaatcatctgatattttaagaagtgaagaagatagtatagaagaatatagtactaatactccagaagtagcaatgtatgatagtggagaatctagaagtattgagaaagattatggtgatgaaactcaaaaatcagaattaaatttgatgtatagtatagatggtagttttatagatattagtaatataagtaaagttgttattaaatctatgggaagtgataataaatataagtctgtagataatattacagatatagaaaatattattggatttattaatgaaatttctaaagaagaagttgaaaggcaagatataaatgattgggattttttaattcaaactagtggaattggcattaataacactataataattcaagatgatattatgaatatagatgataaatggtataagataagtttagaggataacaagaagcttaaagaaatttataataatttaagttatcaagaagatgatataccatattgtaattagtaaatgatatgaagaaatatgataagaatttaagtataaagattgtatttagtattgtaatagggttaattattatttacttaattttaaatcaattttctaaagttgcggggacaatttgtttaataagaggattaacaggtataccttgtccttcttgtggaataactagagcaatgatagcagttttgaacggtaattttatagaggcatttaagttacatccattattttggatgccttttgctatagtaatattaataatattaaataggaaatattataagtggatattaattggagctattgctatttttattggagtttatatagttaggatgagcattttctttcccgatatagaaccaatgaaatataatgaaagggctataattaatcaattaataagtaaaattagaaaatgatgagggaagtaagcgacaaatgacaagttaacgtggaaactccttatagagtttctaaatatatagtctaaattcagccttaactgaatttattgattaacttgccatttgtcacttgaaatttactttatactacttggaaaataaagaattttaagtagtatgattcatcagaattccaaaggattggatggtctgaactttgagttctaacttcaacttgtcttaaggttcttcttgcatcatgcgcagcttcaagaacagttttctttaattgttcttcgttcatatagtgagagcatgagcatgtagcaaaatacccacctgatttaaccatttttaaacctctaaggttaatttctttataacctctaattgcagcatttactgtacctcttgattttgtaaaggcagggggatctaaaattacaacatcatattgtctaccttctcttgaccaatctccaagaacgtgaaatgcattatgacattcaaatttaactgtatcttgtaagttatttaattcagcatttctagtagcacaatctacagcatgttgagaaacatctattccaagaactgattttgcaccagcaattccagcatttaatgcgaaagatccagtatgagtaaagcaatctaaaacatctttacctttacatattctatgcatagcagctctattttctttctgatctaagaaaaatccagttttttgaccattttctaaatctactatgtatttaactccattttcaataatttgaatattagtatcaaatggatcagttaagaagcctttagtttgttctaaaccttcaatttctctagtttttatgtcacttctttcataaacacccttagccccatattcttcaactagtattttaactattaaatctctatattgctccattcctagagtagatatttgaattacatagtaatcttcaaatttatcaactgttaaaccaggtaagaaatcagcttctccaaatataaatctgcaagatgatgtgtcaattacagtttttctataatcccatgctgcagcaaatcttcttttaaagaaagcttcatcaatttcttcatttatatctctagtcattattctgatagttattttacttctatcattaatataaccttttcctataaagtagtttttatgattatatacttcaacaatatctccgttttcataatcaccatcatattcatttatttcatctatgtatatccaaggacggccttgttcagctcttttgttttttccttgatgtaagaaaaatttacatgccataatattatttgctccttttctgttaattctcataagattataacacaactattgctttagtgttatgtactttgttattaagtattaacaacaatgatagaaaatatagttagtcatagatataattataaataatatagaaatattaaagaggtattatatgaattatgtttatatattaaggtgtaatgatgatagtttatatacagggtggacaaacaatctagaaaaaaggataaaggcacactctgatggaaaaggagcaaaatacacaaaagctaaattgccaattgaattagtttattttgaggaatttgaagataaaatagaagctatgaagcgtgaatatgcaattaagcagttaaagagaaaggataagttagagttaataaagaatagtaagtatataaagacttagggggaaaaactatggatataaaaataaggccaataagaatagaggatgcagaggaaattaatgcattaaggattatggatggagttagagaaaatatacttggaataactagtgaaagaatatatagaagcaaaaattttataagtggcttaaataataatgctcatatgtatgtggcagaaataattgaagatgaaggaagtaaaataattgggacaataggattacatgtttcagagaatcctagattaaggcattgtggaagcataggaataatggttcataaggattatcaacaaatgggaattggtaaaaagcttatggcaactgttattgatttagcagataattggttaatgcttaaaagattagaattaggagtatttactgacaatgtaagagctttaaatttgtataaatcatttggttttgaaatagaaggaactaagaaatgttcagctattagaaatggaaattatgaagatgaatatattatgggcagaattagaaattaaataaatatttgaattataataaaaaaccacttacagtgtaagtggtttaaatcgttaaacttataggggagtttgggagcggggtattattttgaataatccttaattaaatcttctatctttgatttacatctaaatccatggcaacttccagtgcaagcaccggtatctttagaaacctcatcaacggtatgggctccatttttaatggattccttaattttagctctagatatagatttacacgtacaagtttttgtaattttatcaaggatatcagcatttaaattattttccataatagatcctccaaaatacaaagatattaggaaacacaaaaattaattattaggtaaactaatttttgagtaatacgtttcaacaactatattaaatcatagtataccaaaatagtcaacaataaatattaaataataattattattgattgagtataaggcggataactaataatgaagagttaaggagtaaatttggtttaggctaaatttagaaaactatatttaagaaatcttctaagggattttaagtacaacttgtcacttgacaattgaaacggaaataaactttttgggtacaattgacaaagagatatttaataatatataatgaattcattaaagactatgattaggataagtactttgatttattcttttaagagagtgattgtttggtgtgaaatcataagaagattagaggaaaatcacctaggagtttgaggctgaaagttttatacaattaagttatcacgtttgctcgcgttaagggatagggtatgaaagtatctgaaataatgctcatagaataattatgagtttattaaccttaggtggtatagcgaattcacttcgtccttttgggatgaagttttttttattttaaatgaatcttaaaattttgaattgaataattaaagttagatagtagtgaactaattcaagtataggaaaagggatttcattaaaaaataggattaaaatatgtctttaagagaataattttaatagttgataaacgtaaagaaaggagaattcttatgtacaataaagttgaattaccaaatggttttgttggacttgaaaaagaaatagcaaacctttggactgcgagaaatgttataaaaaagaattttgatatgaatcaagatggtgagtatttcactttctatgatggacctccaacagcaaatggtagaccacacgttgggcacgttttaacaagagttatgaaggatataatcccaagatacaaggttatgaagggatataaggttatcagaaaagctggatgggatactcatggtcttccagtagaacttgaaatagaaaagaaacttggtatttctggtaaagagcaaatcgaagaatacggagttgaaaagttcgttaaagaatgtaaagaaagcgtatttacttatgtgagtatgtgggaaaaaatgactaaccaaattggatattgggtagatatggaaaatccgtatgttacttaccacaatccatatatcgaatcagtttggtgggcattgaaacaaatgtgggataagggtcttttatatgaaggacacaaagtaatgccatactgtccaagatgtgggactgcattatcttctcacgaagttgcacaaggatataaggatgttaaggacttaacttgtatagctaaatttaaggttgtaggagaagaaaacaagtatatactagcttggacaacaactccttggacattaccttcaaacttagctttatgtataaacaaggcttatacatatattgaagcaaaagttggagaggaagtttatgttttagctaaggatttagctgataaagttttaggtgaagaatacgaagtagttaaagagttcaaaggcgaagaacttttaggaactaagtatgaacaattaatgccttttggtaaagttgaaggaaaagcatttgaagttattcatggtgattatgttactttatcagatggtactggtatagttcatatagctccagcatatggtgaggatgatagtttagtagctaaagctaatggaatcactttcataaacttagttgatagagaaggtaaattcgtggaagaagttactccatgggctggtaagtttgttaaaaagtgtgatgaaagcatttgtaagtggttagaagaaaataataagttatttaaatctgaaagacatatgcactcatacccacattgttggagatgtgacacaccacttctttattatccaaaggaaagctggtttgttgcaatgacaacattaagagataagcttttagaaaataataataatattaactggtatcctgataacattagaactggtagatttggtaagttcttagaaaatgttattgactggggtatttcaagagatagatattggggaactccacttccaatttggaattgtgaatgtggtcacaaagaatgtataggaagtattgaagagcttaagaaaaagggaatcaatgttccagaagatatcgaattacacaaaccatatatagataatgttcatttaaaatgtgaaaagtgtggtaaggaaatgacaagaactaatgaagttattgactgttggttcgattcaggatcaatgccatttgctcaattacactatccatttgaaaataaagaattatttgatcaaaatttcccagctcaatttatatcagaagctgttgaccaaacaagaggatggttctatactttacttgcaatctcaactgcaatatttgatagaaatccatttgaaaactgtatagttttaggtcacgttcttgataagaagggcttaaagatgtcaaaatcaaaaggaaatgttgtagatccatttactgtactagactcacaaggtgctgacgcaacaagatggcatttctatactgcaagcgcaccatggttacctacaagattctctgtagatgatgttggagaagccggaagaaagtttatgggaacattatggaatgtttattcattctatgtattatatgctgagttagatcaattcaatcctctacaatacgctgattttgtatcagaaaatgtaatggataaatggattatgtctaaattaaatactttagttaaagatgttggctctatgttagattcatatcaaataactcaagcggctttagctattgaagacttcacagatgagttatcaaactggtacgtaagaagaaatagaggaagatattggactcaagaattaacagatgataaaataggtgcttatgtaacattatatagagtattaactacagtaataaaagttgcggctccattcgttccatttataacagaaaatatctaccaaaacttagttgttggattagataagaatgctgaagaaagtattcacttatgtagatggccagaagttgatgaaaaggctatagataaggaattagaaaaggaaatggacttagcttacactatagttaagcttggaagaagtgcaagaaatggggctaacattaagaacagacagccgctttcaaagatgcttgtttctactgattcacttccaagatattatgatgatataataactgatgagttaaatatcaaagaagtagaatttggtgctgacttatctactcatgttaactttgaaattaagcctaacttacctgtattaggaaaagcttatggtaagttaataccagcaataagaaaagaaattgctgctagaaaccaaatggacttagctcaaactattcaaaatggtggagtagtagttataaatgttgatggaaatgaaattgaattaaataaggaaaacttattagttactatgcaagggctagagggttatgcatttgctggtgaaggttcaattggggttgttttagatacaaatattacagaagaacttagagaagaaggccatgtaagagaaatgatctctaagattcaaaatatgagaaaagataaagggtttgaggttgcagataaaattaagttatatgttgcagataatgatatgttattagatattgttaaaaaatatgcagaagtaataaagaaggaaaccttaactcaagaaatagtttacaatgaagaagttgattattcagatacagttatcaatggtgaaaacttaaagatgaatgtagaagttataaaataattaatagatttattgcaaagggtagggattaagtaataattcctacccttttttcaaagaatagtattataggcaaattgtttaaataaagagtgtaaaaaaggttaaaattattgtattaaataggaaaaaaaggtataattaataattaaaatagaaaatggagtgatgttggatatggctacttctataaaagatgttgctagagaagctggcgtttcaatagctacggtatcaagagtattaaatgatatagatgttgtaaatgaagatacaaagaaaaaagttttagatgcaataaaaaaattaggatacagacctaatatagttgcaagaagtttaaaaacacaaagaacaaaaacagttggaatattagttcctgatatctcaagtggattttatcctgaaatagtaagaggggcagaggacgttgcaaatatttatgattataacgtaatattatgtaactcagattttgattatgataaagaaaaagattatttaagagtacttaaagaaaaaatggttgatggtgttatatatatgagctcttgtttagaggaagagactctagatataattaatgaacttgatttaaagacagtacttgctgaatcaagagacagagaaggtagattaccaagtgtaattattgataatgttggagcggcatatgatgcaactaagagcttaattgataagggattaaaaaatatcgcatttgttggtgttaataaaggatctgttaatgcttgggaagatagacatataggttatgagaaagcattagaagagaatggcttaaaggctgatgaggatttaaaattctttaaggacttaaaagttaacagtgggtacaaagctgtagaaaaattcgtagaaagtggcaagaattttgatggggtagtatgttcttcagatgaaattgccatgggagtaatcaatgcattaagggaaaaaggacttagagttccagaagacgtaagtgtaattggatttaatgataatgcagttgcatcatacttctatccaaaaataactacagtaaaacaaccaagctatgatatggggtctgtagcaatgagaatgcttattaaaatgttaaataataagccactagaacaagatcaatatgttttagattacaaaatagttaatagagagagtactaagtagatatgaaagtgctataaatttcaatgatttatagcacttattttttttattaatataaaaaaaagttgtaatcaatttcaaaaaaagtattgttttttaaaaaatggcatgatataatagtaataaaattggtaacgtttactaaaagcggttatatctaaaattgggtacacaatcaattaggtataggcaatatcactgggattattgagacttagagaatttgggtataaagtaaggttataaaataaaaaaataataattgctttttagtaactaaaatgaaagaggatagattttactatcctctttttgatttcaaatgatatttaagtaaaatatcttataatattccttctgttttaagtaaattttctaatttttgaactttttctgttaaagtcatgaatttttgttttaatatagtattttcttcatttccttcattaatgtagctttccatttcttctacagcttttaatgcttcatcaatatctttttgagctagttttaaatttgattctttcatttatgtatctcctttattaggtaaataaaacttgtatgaaaatccttctaagtacccttgaaggtgaaagtaaaactcaaaaaatagaattttacttatgttaatatctttatcctatcactaataaatatgtgatgcaaggcatatattgtaaagtaaagaataaagagaggagaaaaaatgattaactatatatggtttttaatgatttttctgggtttgatagttgggatatttactggtaatggtgaagggatatctaatgccataataggatcaattgattctacagttacttttataattggactagtaggtttaatgtgcttttggtgtggagtgatgaaggttgcagagaaaagtggctttactgaaaaactagccaagcttatgaaaccaatattaaagcttatttttaaagaggctgcaaaggatgaaaaggctttaggtgctatagttatgaatataactgctaatatgatggggcttggaaatgcagcaacaccttttggaattaaggctatggaggaaatggatagattaaataatgaaaagggacgagcaagtgatgacatggcattatttttagttctaaatgcagcatgtattcaattagttccatctactgtactatctataagagcagccgcaggttcttcgaatccaggggtaataatacttccagcaataatatcaactggtactgcagctattgttggtgttatttgttgcaaaattttgcaaagatatttttaagtttatggggtgatattaatgtttagctatataactaaaagtattattcctataatagttttaattattattacttatggaatgataaaaggtagaaaggtttatgattggtttgttgaaggagcgaaagaaggattaaaagtctgcgtgaatatttttccttatcttttggcaatgataatagcagttcaaatatttagagaagctaatctcttagacatgttaaacaatgcaattgccccactttgcaagctaatcgatttaccaaaggaggtcgtacctttagtattaatcaagcctctttcaggaagtggagctatgggagtttttactgacattttaaaaaattacggggctgatacacctataggtttagtagcttctgtaattatgggaactacagagacaatattttatactgtgactgtatattttggagcagttaaaataaaaaaaacacgtcatactgtttgggcagctataatggcagatatgtctgctattataatggcaatattaatggttaaagtacttattctttaattatgagttaatgctgaaaagttaaggatattattttcagaaattagtatgattttcattaagaatttatattattcttttaagtaatatctttaatttttctaattttcatcattattaaaaattagaaaaaggttaaatttgcaaattgcataaaagcaaataattttttgaatgtaaaatttatagtgcgttgtaaaaattttggttgtataatattaatagaataaatcgaatggagaatgattatgggggaagatagattttacattgtaaatgaaagatcattaccagagatatttaaaagggtaattgaagtaaaagagaatattgaacttgggaatgcaaaagatataagtgaggctataaaattagtaggtattagtagaagtacatactataaatataaagatgatgtatttccaatgggacaagatatgcaatcaaaaaaggtaactttaataatcttaatgacacataagtcaggaacattatctaaagtattagattgtattgctttttataagggaaacatattaaccataaaccaagatattcctataaacttatcagctaatgtaactgttactattgatatttcacatatggagaaaagtataagtcaattagctgcaaggttaaattctttacccaatgttagaagcgttaagttattagcagcagagtaataaaactaaatgacaaaatattatttgcaaggagatagggctatgaacaaaaatatttataaatttaatagagataatcttttagataaaattaaggataattcaattgtgattttatttgcaggaaaggcaattcaaaagacaggagatcaaacttatccttttacaccaaatagaaatttttattatttaacaggaataaaagaagaagatcatatattagttatgacaaaaattaatggagtaaaatcttctaaactttatataaaaaacattgatctagagatggaaaaatgggtaggtaaaagcatacgtaaggaagaagctgaagagcttgcagctgtagatgaagttaaattcaagagtcagtttgacggagacatccatggaatgattactatgaaagaagaaataaatctttatttagatttagaaagaatgagtgcaaacagagaaggaactatttcacatagatttgccaatgaaataacaactaagtatccacaagttagaataaataatgtttatagtaaaattggtgaattaagattaaaaaaatcacaggaagaagtagataaaataaaaaaggctattgaaataacaaaaagcggaattgaaaaattaatgtctgaagctcgtgttggaatgaaggaatatgaattagaagcatattttgattttaattgtaaggttaaaggtgcaacagggctagcttttacaacaatagctgctgcaggagaaaatgctacaacattacattatgttgataataattgtgagcttaaagaaaatgatttaattctttttgatttaggtgctgaatataattgttataatgcagatatatcaagaacattccctgttaatggtaaatttactgaaagacaaaaggaagtttataatgctgttttaagagtaaatgaagaaattataaatttaattaagcctggtatgaaatataaggatgtaaatgaaaaagctactgacttaattgcagaagaatgcataaagcttggattaattaaagataagagtgaagtaagaaagtattattatcatagtataggtcatagtttaggtatggatactcatgatattgaaactccacatagagatattgtttttgaaccaggagtagtatttactgttgaaccaggaatatatattgctgaagaagaaataggaattagaattgaagacgatattcttgttacagaagatggagttattaatttatctagtgatattataaagagtgtagaagaaattgaaaattttatgagcaaaaatagaaaatagtatgtataaaaagttataaaatggtattgcaaatataagaaattgattatataatcagtttgtaaataacaaaagtgaataaactagggtagaggcgcgaaagttaatagtactattgatgaggaaagcactgtgattcaataggaaaggagcaatcgccgaagcgtacaactaatgctttaaggttgtatggctgggaatacatagaatatatgtattactgtcacaaagtattttgtggtgagctatcatttaagacttgtagtttcatattttttagtacatacaaggccttgagtgttaactcaaggtctttttttattgttagtttggggtgcccttattattcgcttttatataaaataagggggaaaaagaaatgaaaagaagttataaagtattattgcttacaatgttagtatttgtagtttcaacgtcagttgtatttgctgcagaagttgaaccagcagcagttaatgcagataaatttggattatggacattacttccaccattagttgcaataatattagcatttataacaaaaaatgttgttatttcattgtttataggaattttatctgggagttttttgattagtcttgcaggacataatgtatttggtgcatttatacaagcatttttagattttgtaagtagagcattaaattcattggctgatccgtggaatgcaggaatagttcttcaagtacttgcaataggaggcgtaattaatttagttgcaaaaatgggaggagcaaaggctatagcagaggctttagctaaaaaggctaaaacagtaaaaagcacacaaatgacaacttggcttttaggattatgtgttttctttgatgattatgcaaattcattaatagttggaccaataatgagaccagtagctgataaaatgaaaatatcaagagaaagattggcatttattatagatgctacagcagctccagtggctggactagctattatttctacttggattgggttagaagtaagcttaattggtgaaggatttaattcaataggtgtagatgcaagtgggtttggagtgtttttacaaacaataccttatagattctataatatattaatattagcgttcatagtaataacagctttaacattaaaggaatttggaccgatgaggaaagctgaaattgctgcaagaaatagagataagaatattaaggatgaagttgcagttgaagcatcaactcaaatggatgaattagaaccaaaagaaggtgttaagcttagtgtatggaacgcaattgttccaataggagcattaataatttctgcattagtagcattttattatagcggatatagtgcaataatggcgggagatacatctgtagctcaagagattatgataaattcaccattttcatttaaaggtataatggaagcatttgctgcttcagatgcttctatagcattattccaatcagcattatttgcttcaatagttgctattttgatgggtgtttgtaaaaaaatatttactttaagtgaagctattgaagtttgggttgatggaatgaaagggttaataataactggagttatattaatattagcttggtcattaggatcagtaattaaagatcttggaactgcatattatttagttgaagtattaaaaggagcaataccagcattcttattaccaagtttaatatttattttaggggcagtaatttcattctctacaggaactgcatatgggacaatgagtatattaatgccacttgcaattccattagcatattcaattaatccggatatgtcatttgtagtagtttgtacaagtgcggtattaacaggagctatctttggggatcactgttcaccaatatctgatacaacaatactttcttcaatgggagctggatgtaatcatattgaacatgttaaaacacaaatatgttattcattatttgttgcatcagtaactatattatttggatatattccatcaggatttggaattccaatatatatagtattgccaatttcattaatagcattatatataggggtacaaatattcggtaagaaggttgaaggagcttaagcaataagaaaaataaataaagagggctatataatagaagggttatgcaaaagcataacccttttttggtcgttttaatctgtaattttgacttcctttttctttactacgaaaaatgctattataagtccaattaaagataaagctgcagtgcaagcaaaggaaatattcattccataaatctgagccttgataggattggaaattccagaggaaagactagccttactcattagggttacaattattgaagtgcctatagaaccagcaacttgccttaaggtattatttgcagcattaccatgggcataaagatctctatgtaaagaatttaaaccagaagttgttaatggcatcataagcatggaaattcctaacattcttaatgcgtatactattattatataagcaataggtgtattcatagaaagaaatgaaagcccaaaggttcctattgttaatattaaaagtccagataatgcaaggtatctagcaccaaatttatcaaataacttacctgtgataggattcataattcccattacaatagctcctggcataagagctaatcctgtattaaaagctgaagagcctctaatattttcaagatacataggaagtattaattctgatgaaataagtcccgcataagcaatcattactattattgttgagaatgtgaatgcagtgcttttaaatacatttaaattaagcataggttctttcagagttaattgtctccacacaaatattacaagaaaaactataccaacaattaaaggaatatatacatgggtattagtccaattgtaatttccagcattactaaaaccaaaaagtaatgctccaaaacctaatgtagaagaaataaatgaaattatatcaaatgatatatctttattttctgttacattttttaataaaaagaatccaagtattaaatcaataaatgcaaagggtgcagtaacataaaatagatatctccaagggtaactatttattatccaaccagataacgtaggacctatagctggggcaaatgcaaggactattcctactattcccattgcaaatcctcttttatctattgggaagattattaaaaatactgtttgcattaatggaactattaatccacctgctaaaccttgtattaatctagcacttaataacataggaaagttagttgcaaagcatccaacaagagtccctattgtgaaaagacccattgatataaaaaacaaggttctagtcttaaatttatctataaggaatgcactaaaaggaattataataccattagcaagcatgtaacctgtactaagccattgcacagtagatacacttatatttaaatctttcattatatcggataaagcaacattcataaaggtgctatttaggaagcagataaaagcacctaaaagaaaaacactagaaatgacaataatattataatttttattattagtagtttcttcagtcataaaatcacctcaaaaatttattatatatgtagttatatttccaaaagtgaaattatcttatgcaaggattttgtagaataaaaaaaggctcatctaaataagatgagcaaaataaaaatatgtatttagtagtattaaaaccaactatacaataattgattttaattattgtatagttgattttaattatttatttggtggtgggtttataagcttattaactaatattgaaattactattccaagtaatgtttctattattctgttagttgcataaaataaaggatcactataagcatgagctgtagtaacacctaaaaatgcaatacaggttatattgatagcacctggcctttttataatattgcatagataaatcattaagataatacctatagcaataattaaatatataagtggttttgatatgtaagtattagatatatgattttctaatgttctaaataagaataaaaatactaagccaaaactagcacctaatatagtacctgcacctctatttatacccatatgaattgagttataaacagtatcttgtaaacaaattactgcagtgaggcaagcaaaaaaaggttcgttaggcaaaagtaacaaacatagaaaaacagctatacctgattttattgttctaagtccaaccttaggaaattgaaatttttccataattaagcctcctatccccttagatattatatctaagaaatagtcaaatttcactatttaatattatattttttattaaaatcaaaaaatgttaaaaattatatattattcatactttataataaaaatgatttataattatttttaagaatatatagtaaagtggggataaaatggatttaattatacttattattttagaaataattccaataatattgtgggggtgtggatggtattttgaaaataaatattctaaatatcctgatatgagtaaaggatataaatttggaagtgcaaaaaatagtaatgaagaatggcggtatggaaataaagttgctagtaagggttttagtgcaacaggaactttgttatttatacttataataatagcaagattattatttgatactaatataattactgttattttcatattatttattgtgatatgtgtgaattttatggtaatagagggcataataaaaaagaagtttaaaaataaatagaataggtttgacaggttttgcattttagcatattataaaattaataaatgcatagaaaagaagagtagtttaggaatgtatctaaagagagctagagtgggtgagagctagtgttactgaactttatgaagatggtcttggagctgattatctgagcttgaaaaagttagggtaatacgggagcaaccgttatattgcaaggtgatgatagtcacctactgagatatttattgtaaaataaatatgaaatagagtggtaacgcgtatataacgcctctatatgggtataaaagcctatatagaggctttttttagttaggagttttcagttagtagttaagattaaactattaatttaagctatgacttttaatagaaatttgttaacaaaaaagaggaggaagtaatatgactaaaaaaccatattatataactacgccaatttattatccatctactaagttacacatcggtaacacctatacaacagtagcagctgatgctttagctagatttaagagattaaatggatatgacgtaatgtttttaacaggaactgatgaacatgggcaaaaaattcaaagaatagcagaagagaagggtataacacctaaagagcatgttgatgaaatagttgctggaattaaagatctatggggtatgatggacataagttatgataaatttatcagaactactgatgattatcataaaaaaacagttcaaaagatatttaaaaaattatatgatcaaggtgatatatataaatcttcttatgaaggattatactgtactccgtgtgaatctttctggacagaaactcaattagttaatggaaattgtccagactgtggaagaccagttgaaaaatcaaaagaagaagcttatttctttaaaatgagtaaatacgctgatagattaatgaaatatattgatgagcatccagagtttattcaaccagaatcaagaaaaaatgaaatggttaataacttcttaaagcctggattacaagatctttgtgtatcaagaacaagctttaattggggagttccagttacttttgatgaaaaacatgtagtttatgtttggatagatgcattatctaactatatatctgctttaggatatggaagtgaaaatgatgaattatataagaagtactggcctgcagatgttcatttaataggtaaggatatattaagattccatactatttactggccaattatgttaatggcattaggagaagagctaccaaagcaagtatttggtcacggatggttgcttgttgatggtggaaaaatgtcaaaatctaaaggaaatgttgttgacccagttgttttagttgataaatttggtgttgatgcggttagatattatttattaagagaaattccatttggagcagatggattatttaataatgaaatatttataaagaagattaactcagatctttgtaatgaccttggtaacttattatcaagaacagttgcaatgattgaaaagtattttgatggagtaattccagcaccaacagctaaagaagatattgataatgaattaattagcttagctatagaaactccaattaaagtaacaaaagcaatcgataatttaagaattccagaagcattagaaaatgtatttgaacttataggaagggcaaataaatatattgatgaaacaactccttggatacttgcaaaggatgaagaaaagaaagaaagattaggtacagttttatataatttagctgaaagcttaagatttgcatctgtattattatcatcattcttaccaagtacaagtgaaaagattaattctcaattaaatattactacaacaacttggaattcattatcaggatttgatggaacaacaccaggaactgaagttaaaaaaggtgaagctttattcccaagaatagatgtagctaagactttagaagaattagaagctatgagattagctcaattagaagctaataagccaaaagaagaatataaaatgcaaccaattaaagaagaaataactattgaagactttgaaaaaatagatttaagagtagttaaggttttagaatgcgaaccagttaaaaaagctaaaaagttattaaaattaaaagtagatttaaacggtgaagaaagacaggttatttcaggaatagcaatgcattataagccagaagaactagttggtaaatatgtagttttagttgctaacttaaaacctgttactttaagaggtgaattatcacaaggaatgatagtagcagcagctacagatgatgatagcgtattaaagttagtaaatccaggtgaattaccaacaggaagtattgttagataagtgaagttctaaatatttgatttatataactgaacttacacctacgaatgttaatgagtaggtgtttcattaaagtagtgagtgacaagtgataagttaagtaataaagccggcataggccgacttttggaaatgcaaaaaggtcagctttgctgacctttttactataactcaaaactattaactaattaaaagggggttttttaatgaatattattataggtaatgcatggccttatgctaatggacctttacatttaggaagaattgcagttttgttaccaggagatattttagccagataccatagaatgatgggtgatgatgttatttttctttcaggaacagactgtcatggtactccagtgactatgaaggcaaaagaagaaggaataacaccattagaggctgtagaaaaatatcataatgagtttcaaaggtgctttaaatcattagggttttcttttgatatttttgcaaaaactcattcagagtatcatgaagaaaaggttaaagagtttatattagaactatataaaaagggatttatatatgaaaagaatgtagaacaaacctattgtaagaaatgtaatgaatatttagctgatagatatattgtaggaaaatgcccagtttgtagagaagaagcaactggtgatggatgtgaaaattgtaatggtgaatttgaaagcagtgagttattagatattagatgtaaattctgtgattctgagccagttctaaaagaaactaaacatttattttttagcttatcaaagtttgaaaatgatgttgaaagattatatataaatcaacatggctggagagaaaatgcaaagaagatattaaaaagatatttagatgaaggactaagagatagggcagtaactagggatttcaattggggggttgatgtaccattaaaaggatatgaagataaaaaaatattcgtttggatagaagcagttatgggatatttaacagctagtatgaaatgccttgaagaaagaaaagaagattataaagaatattgggaaggtgaagattcaagggtttactttattcatggcaaggataatataccctttcatactgtaatattcccagcaattctatctgggcttggcataaaagattctaatttgagaataatatcaggggagcatttaaaacttgaaaataagcctttttccgcagtaaagaattgggctctttgggcagattatgtatgtgaaaggtataatgttgatagttttagatactatttatcgttaaattcaccagaagacaaaaatactgattttacttggagagaatatataaatatacataataatgaactggtaggagagttaaataactttgttggtaaggttttattattttctaggaaaaactatgctaatagaatacctaatggaaagatggatgaaaaattaaaaaatgaaattttaaatttatattttgatgtaggtgataagattgaagaaggtcactttagagatagtttaaatgacataatgaatttatgcaaaaagggaaataaatattttgataatagtaaggtgtgggacttattaagcagtaatccgagcaaatgtaaggctgtgatttataactgcattcaaattatagttaatttatcaaatttattatatccatttatgccagaaagttgtaaaaaaataaaacaatctttaggactaagcgaaggagtttggagtttcactgaaaggaaagaaggattagttaaagaatgtgaagttctttttgtcaaaattgataagaaaagagctagcgaagaagttgctagattgaaagaaaagaaaaattaaaaaaaacctagagttatttcatttgggggacgaataactctaggaaaccaactttacaagatggttttaggggtaaataataatgctttaactactttacaagtattataataaactttaaatgtgtcatttaggtgtcaaatttctgaagaaaatattaactattcttaatataagctaaatttaaaaagttttatcgttgaatttactagaattagtactagtttcaaggataaaatttttttgaaaaattttaatctttatatgaactattttaaatcttataaaagaaataaatatatatgatattgttgataaaaatttaaatataaaaaaaggaagcttttattttaatatttaaatattaaaatatcaatatataagaagaaactcagtattagctgagtttttttactttgttttggtataataaacaatataattatatttttttaagggagaaataagtatggaatttagatatgaaatatttgacacacattcacattatgatgatgaagctttcaatgaagatagagaagccgtctttgaacaaattaaaaatgaaggagtagtaggaattttaaattgtgcatgttctaagtcaagcttaaaaactactaatgatttaacgttaaattatgactttatatatggagctttaggaattcatccaagtgacgcaaatgattataatgatgaggttagaaaggaaataattgaattagcaacaaataataaaaaaatattagctataggagaaataggattagattattattgggaagaaaatccgcctagggatgttcaaaaaaaagtgtttagagctcaaatgaaattagcagaagagttaaatttacctgttgttattcatgatagagatgctcatgctgatacattagagataatgaaggaatttccgaatgtaataggtacagttcattgcttttcaggaagtcttgagtttgcaaaagaatgtgtaaaattagggtattatataggtattacaggtgttgtaacatttaaaaatgctagaaaaatatgcgaagtagttcaagggattccgttagatagattattagttgaaactgattgcccatatatggctccagtgccaaatagaggaaaaaggaataaatcggactatatacgatatataatagaaaaaatagctgaaataaaggaaatttcttcaaaagaggttaatttggctgtaaatgacaatttctatcgcttgattcacaataagaaataaagtaaaataaatactaacaattgtaaaatttttctaaaaatttataaacagtatctacaaacttcaaaaagcaaaatgccattatttatttttattcaaattaattattaaaggtgtattttattacacttaagaaacaggttttattaaggatagggtgggaaatttgacaaaaacatgaattatttatataattcaatggtcgctcttgccagaggaggttaaatgtagatggttgaaaaatggaaggaaaacttaagaaacaattttactaatagtcctaaggcaaaaataattacaggtgctgtaagtgttgtattagttacattagtaataacacttgcatgtatgagaaaaaacataacaataatcattgacggaaaagaagaaacatttataacatataaagggactgttaaagatgtacttgcagataaggagatagaaattgctcctaaggacaaagtacaaccagctttagatgaaaaaatttcatcaagggatgttattaacattaagagagctgtagagattgaaatggtagttaatagcaaaactattgttataaaaactgctgaagatactgtaaaagatatgcttgaagctgaaagtgatgaacttaatgctgaaggaattgaatttaatgaaggattagatgaaataacgccttcgttagatactaaaatatcagataaccttacgattcaattggttaaggttgaagtaacaaatgaagtagctactgaagatattgattatgaaacaatagtggaagaggacgaaagtttagatataaacactgaagacgttagacaagctggtgaagctggtcaaaaagaaataacttataaggttgttaaaaaagatggcaaggaagtatctagagaagtagttcaatcaaaggttattaaagaacctgtaaacgaaattatagcgcaaggtaccagaagggtatttgctagtagagatggagaaatggagtataaagatttaatttattgtgaatctactgcatatgcaggagatactattactgcaacaggaactgtgccaagttataatccaggtgggataagcacaatagcagttgatccaagagtaattccattgggtagtttagtttacgtagaaaattatggtaaagctattgcggcggatacaggtggtttaattaagggaaaaataatcgatgtatttcttaattcagaatctgaatgtagatcatggggaagaaaatataacgttccagtatatattttagcatatcctggagaatggtaatattaaaggaggttagttgttggactagcctcctttaatatttttaaaaatttagtataaaatttatacagaataatgaatataaatttacaaaggtttgacattatatgaatataaggataaattaataagagataataaaggaaaggaagagattcttttgattaaagaggttatagtagttgagggaaaagatgacatcgcagccgtaaaaaaggccgttaatgcagaaatgattgccactggtggttttggaataaatgctaaagttattgctagaattaaagaagcacaaaaaagaaaaggagtaatagtattaactgatcctgattttgctggtgaaaagataagaaagataatagcaaagagagttccgggaataaagcatgcatatattgcacaagaagatggaattaaggatgatgatataggagtagaaaacgctagtccggaggtcattatagaagccttaaatagagcaaagattacattagaagaaaaggttgaaacatttgatactcaagatatgttttattttagattaaatggtgatcctaatgcaaaagctagaagaataaagcttggaaataagttaggaattggttatggaaatgcaaatcaaatgttatcaagattaaataattatggaataactaaggaagaatttatagaagctattaaatacgtagatgcagaactagagaaggagaaataaatggatataaaagatgtaaaaacagctgagttggttaaaaagtataattttaagttttctaaaagtttaggtcaaaacttcttaattgatgattcagtacctagagatatagtttcaggagcagaagttgatggagaagatttagttatagaaatagggccgggagtaggtacattaacagctcaattattaaagagagctaaaaaagtagttgcaatagaattagataatgacttaataccaatattagaacaagagttaggagataatcctaattttacacttatacataatgatgcattaaaggttgattttaatgaagtaataggcgaagagaagagtgtaaagctagttgctaatttaccttattatgttacaacacctataatagtaaaattacttaaggatgggtataattttaaatcattaacaataatgattcaaaaagaagttgcagagagaatgaatgcagagcctggaaataaagattatggggcactatctttacttgttcaatattactgtaatacaagtattgtaagaagggtaccgccaagttgttttatacctagaccaaaggttgattcaatagttattagattagataagcttagtgaaccaaaagttaaggttgaaaatgaaaaattattctttgatataataagaaattcttttaatatgagaagaaaaactttatggaatggtgttaagagcattggaccagcaaaggaaaaacttgaggaggcttttgaaaaggcaggaattgatcctaagagaagaggggaaacattatctatccaagaatttgctatgcttgcaaattgtatcaatgaaattttataatacaagtgttatttcaaattataaattctataaagccaataagtaagccacttaaaaataggaacatattttataatgttgaacatataatatatggaattaatataaagtgggggttctagagaatggcaagtaatagtagattgtatagaaacttcgtaattctacaggaggatgaacgaggatatgcaaactctgatgataaaacattatctggatattctaagatagaagcaaaaggagataaatgtaaaatttctttctatgctcaaaatcttaaaaaagatgatgataaatactacatgttacttatttgttgtaagaaagatatgaagcaaatagtgaatttgggtcctttagacgtaagtgatagtggtaaaggtgaagcaacaaaggaatataatgtatcaaacattgctggattaaatttagagtttgataagatttgtggaactgctatagccaaaatgaataataacactccaatttttgtaatgtgcggatttttaaatggacaacaacctagtgaaaattggaagagttatattgttgttaaagccaaagatgttcgggtaataagagcagcttcagataaagattctaagaaagaacaaagaaaaccagagttaaaaaagaaccaaagtaaatcaagcaacaatgaaattaaagattctaaggtagaagaaaaaattactgaagaaaaaattgatagagaaaaaattgatagagaaaaagaagaagaattaaaagaagaagttaaaatacaagaagtagaagaagtaaaagaggtaaaagaggtaaaagaagtaaaagaagaaatttcaaatcaaataatcgaagaaattaccccaagagaaaatttaagaggtaaatttgaagattatgaagatgaaattgaatctaataaagaattcgatccagtaagtggaaagataagaggaagcataggagagtattttgaatcaatagttgatggatttgaaagagattatagtagtatagatgagttaaaatacacaaaatggtatagggtaccaattcatgatttacatgaaatgtgtaatatgtctaattataataagtatacattagcttattatccaatgctgaattactacccatatattaagaaatatggatactttatgattgggtataagtgtgattcaagaggaaatctaaaacatattatttatggagttccaggaaagaaggataaggatgaacagccttatgatggaaggacaggttttgtaacctgggtaaatactaatggaaaaagtagtgatggctgttggttaatgttttatgattttaaaaattcaacagttgttgttccaatgcaataatgaagaacatagtgcttagatagtatatctaaattttttttgaagattaatataataaattaaaataaattgctaatattggaataaagtattataattatctttattaggagaagcatatgcttctcctattattttaattaacaaattaaaaggagatacaaatgttaagggcattaaaaaaatatattttaagttcatttttaataatgtttgtacttagtttttcggggtgtacaattatagaaaatgttgaaaaaaagtttggattgaagaatgattattttgagtatttaaattcaagtgacatagaacaaattagtatacaaagtacaagagatacaggatttaaatttatagtaacagaaacaagcgctattagagatatttataatatattatctagagcaaaaataagagaaaataaatcgagtttggagccagattataagtttgaatttgatttaggtgatgaagttaaagagttttattatgtggttggaacagaagatgggaatttttataacgatggtaatacattttcagtttctaaaagattagatgaagtaataattaaaaatttatcttttataagaaagcctagggatttcgattatatttattatcaaaccattttagaaatattacaaccagtaagtaaagttgaaaatataaatgattataaggtaggagtaaacataagtggagatatagattgtttaaaatatgtattttctactgatataaatagttttttagataaagctaaacaaattattccaaatgttgagctagtagataataatgaggtagattttgatatagttgttactgtaaaaaatagaggatatgatagcagtaattttaaaacattaattactgtaaaaaataaaaaggaaaatacagaagataaatactatgtttcagcagttaatgagttcaaagaatggagcatagaggtattgaagagtaaacctaaaggttggtaagaggggttaatagtttaaggataaaacttcttatggagtttctaataatatattttaaagtctgcctaggcagactttatttttttactattaactattaaatggttgctatattagatttaagcattctaactaatctttctaccggtaataatgtaagtaaaactaagcaaattattaattctccacctacggctagaccgttaacgcttagtgaataaataattggagatataccttctggtgcatatgaaccaaagaaaactacgcctgaaataaaatgtgaaataaagcgtagcaacatactgacacttgctcctaaatatttatttttaaagaatccggcaactccaacagccataaatggtaatggataatcaaataatacttgaatgggatttaagatatatggatctagtattaatttgaataatccaaaaaggaaacctgtaaatagtccaatagaagggccataaacaaatgaaataatgattattggaatcatactacctaaagaaatgcttccaccgccattaggtagggaataaatctttatcatgtctaagataaatgctaaagcaatagctagtcctattcgtgctattaactttgaattgaattttaatgatttaaatttaataaaagcaattaataaaattgcacagccaactaaagtgattaatgttaatgggctgctaaaaatagttttgaaattttctccaagtgttgctagaaaatttgacataaaaaaatacctccttatttgcgtaagaggtacctaggcattagaatatatataatttattctataatggctttcctacgctggaattatccagatcaggttaaaagggttgatgaagaagtcatctctcagcctttgggcacccctagcaactttatattaaatatattttagccataaatttacaaaaagtcaacattcttattaatcatttgagaagacttataatttgtattagaagatttattaaataaattagttaaacttatattagtgcctataggcataatagtttcaaatgaagttagtggcatagttataacagaatcatcctctaatagtatgaaagcatcattgcctgtataatctaatatcattcctttcatgataatacaccatcctaaataaatttttattagtttacccttaaaatataataaaaatacatccaagaatgttcttggatgtatttttataaatataaatctttataaacaatttgaaagacttttaaagattcttcaattttatgcttaagtaatttttttctattagtaaattccttttcgcctaatggtgttaatgaataaaacttttgaaatttcttttttggatcatcccattgtcctataactaatccttccttttctaacttttttaataaaggatagattccaccggtactaggggtccaaagaccattagttctttctgcaacttttgtagagatttcattaccatttgtaggtccagattttaatatatggagtacataaatgggtaataagccttttgtaaaaatctgaccaacagcttccttttctttttgtactttttttagttcagcaagcttagctttatactcatcatgtagtctcttttcctcagctttaatatcttctagattgttaaaatcaaagtcgcccattatttatttttccattttaacagagaatcctattaatccaggaccaccatggacaccaagagcaggacttatttctgcaattttagttgaagctacatttggtaatgattttatagattccatatatttagtagcttcttcttcacagccagcatgtaaaactgctacttcacattttcctttttctaaatagccttttaaaatttcagtcattttagataaggattgttttctgcccctaactttagcaacattatagtaaattccattttcgtcagtagttattataggtttaagatttaagaattcaccaacagttcctgctaatcttcctattcttccacctttttttagatattctaatgtactaattgtaaaatatccaataactctttttctaattttaggtaattcttctactatttcttcgaaacttttaccttctcttataagtttagaagtttctataactatttcgccttgaggataagctagtatttttgtatcataaacgaaagaagttaattttggatgatcttctaaagctaatcttaaagcattatagcttcctgaaagaccacttgaaatagaaatacaaatcacgtgtgtatatccttcttcttctaatttatttaaagtttcttcggtttctttagcgcttggtaaagatgttgtcggaatttccttttctaagttagcataaacttcagatggtgaaatatctattctatctctataatcaccactagagtaaattattctaagtggtaataaattaacgttattttctcttaatgtatttaaatcaagatcgcatgcgctatctgtaattaaagcaattttttgcatataaaaaatcctccgataatttattttatatttttagtatatcatatcagataatattatcaatagtgatagggataatattatcactattgataaggttatgcaattttataaaattttattatgttaaattaaaaaatatatataactaaaaactatttacatataattccaaaagagatagaatgtatatgagagttaaaatatacacaatatattgtgtgtaggaggcgaataaagtgctatatgtggtaaaaagagatggcagagaagttaaatttaatactgataaaattggtaatgcaataaaaaaagcaagtgatgaagttggggaacaattaagagaaagtgaagttctagtttgcattcaaagggttattcagtatatagaagagtctaaaaagaaaaaagtatcagtagaagaagtacaaaacctagtagagaaagcattaattgatagtggacatataaatatacaaagagcatattcttcttataggagagagcgaactagagttagggatattaaatcagatttgatgaaatctattaaaaatataggtattgaaacagatagggataatgcgaatgttgggaataatttcagctcgaaattattaagaatagcttctgaatctaataagtggcataatctttataatatgcctaaatatctggcaaaggctcatgaagttggagaggtttatttccatgatcttgattcgtataatttaacaaccaattgtttgcatatccctacaggagagatattaagcaaaggatttaatactggatacggaactataaaccctcctaagcgtatagagtctgcagcagaattgtcttgtatattattgcaatcaactcaaaatgatatgtttgggggacagtctcatccagattttgataatgatatggctcaatttgttgagccaacaagagaagaaataagaaaagaattaatacaatatggaattaaagaagaagaatttgagaatttagtagaggaaaaattgaaatatagaattcatcaggctatgcaaggtgttgtatataatttaaatactatgcattcacgtgcaggatctcaggttccattttcttctataaatttaggaataccaaattctaaagatgctgcattagtttgtgaaatctttttaaaagaatatgaaaagggattgggaaaaggagagcaaccgatatttcctaatataatatttagagttaaagaaggtattaatagagagccaaatgatccatattactatttatttaaaattgcttgtgaggttgcatcaagaagaatgaatccaacatttatgaatatagatgctgattttaataaagaatattatgataagggatatattccagcaactatgggttgccgtacttatttgatgaaaaatattaatggtgagccgggttgcaaagggagaggtaacatagctccaataaccattaatttacctagaatagggatagaagcaaataagaatgttgacaaattttttgaaatattacaagaaagattggttttagcaaaggaagcattgcttcatagatatagcattttaaagcaattaagagttaaagatttgccatttgttgcaggtcagggattaatgaaaggttcggaagggttgtcacaagatgattctattgaaccaattcttaaacaagggacatgggctataggatttataggccttgctgaaactttaactgctttaattggatgtcaccatggagaatctaaagaatctagaaagttagggttagaaataattgagtttattagaaagtatacagataaattaattgaagagacacatcttaattggagttgttatgcaacaccagctgaagggttatcaggaaagtttataaagcaggataaaaaagtatatggaataataaaaggagtaacagataaagattactacacaaatagttttcatattcctgtaagttataacatatcaataaaagaaaaaatagatattgaggctccatatcacaagctttgtaatgcaggccatatttcttatattgaagtagatgactctccatcacctgaggtaattatggatataataaaatatgcctacacaaatactaatataagttatataggaattaatttccatattagatattgtaaagaatgtggaacaagtattgaaagcaatttaagtaaatgtccaaaatgcaatagtagaaatattcaaggggtatcaagagttacagggtatttgagtttagatgaaaggtttggacctggaaagtatgaggaaagattagataggagatcacatacaggaagatataaaaataactatgatgtaatgtgatttagtttatggctagccattataatacttctatctatggagagataacaactgacgtttcctagataacgaattctaaccttaatgcggagttaaaactaaatattaagctaagaattcgctttataaatgcctttaaggatactattaatatagtagtaaccttagaggcatttaacataaaatgaaagaaaatataaaataattgcaaaaattaaaacttcgatcattaaaaaagtaaaaatagtctttcaaaatgaattttaaaatataaaacttgcaatttttagaaaaagatattgtggaaaaattttggatatgataaaatggtaaaataaagatttagttgtaataattgggggaagacccctattttttatatacagctatatctaatgatatataaattaaaagggggcaaaaaaatgtctattagatgtggtaatgataatagggaaatctatatagtagatactactcttagagatggagaacaaacagctggggttgtttttgcaaatgaagagaaggtaatcattgcagagatgctaagtgatcttggggtagatcaattagaagtcggaattcctacaatgggtggagatgaaaaaaaggcaattaagcaaattgttaaaagaaataataatagaaaaagtataatggcatggaatagagctgttatatcagatattgaacaatctatagattgtggagtagatgcagttgcaatttcagtatctgtttctgatattcatattaagcataagcttagaacttcaagagaatgggtattggaaaatatgataaaatcagttgaatttgctaaaaagaatggcttatatgtatctgtaaatggggaagatgcatctagggcagataaagagtttttagtcacatttatcgaagaagctaaaaaagcaggtgctgatagatttagatattgtgatactgttggaataagagagccattttctttaagagcagatattgaagaattatataagaaaacaaattttgatatagaaatgcatactcataatgactttggaatggcaacagctaatgcaattgcaggaattttaggtggagcaaatcatgttggagtaactgttaatgggcttggagaaagagcaggaaatgctgctctagaagaagttttaatggcattagagtatgtttatggagatacagttgatgtagatacaaagatgtttagagaagtatctcagtatgttgcccaagcttcaggaaggattttaccttcatggaaggcgattgttggtgataatatgtttgctcatgaatcaggaattcatgcagatggtgcaataaaagatccaaaaaactatgaagcatttgatccagatgtagttggtttacaaagacaaatcgttataggaaagcattctggaaaagctggtataattaataaatttaaagagtacaatattgaattaaatgatgaagaagcacaaggtgtattagaaatggtaagagctgcttctgttagattaaagagaaccttatttgataaggaattagttaaactttataaagaatataaacaattaaataaagaaaaaaataaggagaattaaagatgataaaattattttcaaatggagtttaccttattaataatagggagattgtagaagattgtaacgaagttaattcaatattggcaaataaacttggaaataattatccaagcaaggaaaatgctaaaaaaaatactattgcttataatattttaaaagaacataatacatcagaaaatatggacaaactaaaaataaaatttgataaattagcatctcatgatattacatttgtaggaataattcagacagcaagagcatcaggattagaaaagtttccagtaccatatgctttaactaattgtcataatagtttatgcgcagttgggggaacaataaatgaagatgatcacatgtttggactttcatgtgcaaaaaaatatggtggaatatatgtaccacctcatcaagctgtaatacatcaatttgcaagagaaatgttagcaggctgtggaaaaatgattttagggtctgatagtcatactcgttatggagcattaggaactatggctattggagaaggtggccctgaaatagttaaacaattattatgtaaaacctatgatattaatagacctgatgtagtaggagtatacttaactggttcaccacaaaaaggtgtgggaccacaagatattgctttagctataattggagctgtttttacaaatggatatgttaataataaagtaatggagtttattggtgatggagttgctaatttaagtgctgactttagaattggtgttgatgttatgactacagaaacaacatgtttatcatctatttggaaaactgataataaaataaaagaattctatgatattcatggaagagtagatgagtataaagaattaaatcctggagctgtagcatactatgatggaatgatttatgttgacttatctaaggttaaaccaatgatagctatgccattccatccaagtaatgtttatagcatagaagaactaaatgcaaatcttaatgatatattagctgaagttgaaaagaaggctggaattagcttagataataaaattagatttacattaagagataaaattcataatggcaagctttatgtagaacaaggagtaattgcaggttgtgcaggtggaagctttgaaaatatatgtgatgcagcagatattttaaaaggtacttcaattggtagtgatgaattttcattaagtgtttatccagcatctcaaccagtatttatggaacttgttaagaatggtagaattgcagatattatggctacaggtgctactgttcgtactgcattttgtggaccatgctttggagcaggagatgttcctgcaaataatggattaagtatacgtcattcaactagaaacttccctaatagagaaggatcaaagataactaatggacaaattgcatcagttgcattaatggatgctagatctattgcagcaacagcagctaataagggatatttaacagctgcaactgatatagatgttaattttacaaaaccaaaatattattttgataagtctatatatgaaaatcgtgtttatgatggagttggaaaagctgatccatcagtagaaattaaatttggacctaatatagtagattggcctaaaatgtcagctttaactgataacttattactaaaagtagtttctgttattcatgatccagttactacaactgatgaacttattccatcaggggaaacttcatcatatcgttctaatccattaggtttagctgaatttactttatcacgtaaggacccagcatacgttggtagagctaaggaaatccaaaaagctgaaaaggcaagactagttaatgagtctcctattgatgtagtaagtgaattgggtgatatatttagtacaattaaagaagtgtttactgatgttaataatgaaaacacaggaataggaagtactatttatgcagttaagccaggtgatgggtcagcacgtgaacaagcagcatcttgccaaaaagtccttggtggatgggctaatatagctcatgaatatgctacaaagagataccgttctaatttaataaattggggtatgctcccttttgttcttaaagaagatttatgctttaataatggtgattatctatttgtacctaatatagtagaagcaattaaagaaaagaaagatagtataaaaggctatgtagtcaataattcaatgaaggaattggaattaaaactaggggaacttactgatgatgaacgtgaaattatattaaaaggatgcttgattaactattataaactgaattcttagcttaaaatggagatttagctatagcttaagatcaaaattcgttatggaggagcgtgtccgttgttagcttcaactgaataggagggagtgttacacggctagctatcagataaagcataaagcataaagtataatgcctttggaggtttagttaaaaatgaataaaactgtgagacttgcaggaatagcttatgaaagtttagtaaatgggcctggtatgagaagggtgttttttgcacaaggttgtaagcataagtgtgagggctgctttaatccagaaacacatagttttgatggtggagaaattatgaatatggataaattaataaaggatgttttagataatcctatgttaaaaggagtaacattcagtggaggtgatccaatagagcaggcccacagttttgcttatatggcaaaggcttttagaagtaaaaatttaagtatatggtgctatacaggatatacatttgaagaacttttagaactaatgaatagtaatgatggtataaatgagcttttaaataatatagatgtattaattgatggcaaatttgagttaatgaatagaaatgaggaattgaagtttaaaggctcaactaaccaacgtataattgatgtaaagaatagtttaagttcaggtaatgtaatagttataggataaaatttttaaggatactaactgtataatagatttattaaatagaatttatcagttaaaaaaaaaagcgcataagcgcttttttttaataatggggggatgggaacctgtatattacaggttttatatttacattataattatgtacagttattagaagttctatacacatttttaaaaaaaatttaaaaaagctactgcattaaaaatgcagtagctctctaaatatattagaaatcagattgcccagtagttcttgggaatggaataacgtctctgatatttgccataccagtaatgtacattattaatctttcgaatcctaggccaaatccagcatgcttagtttctccgtattttctaagctctaaataccaccagtaatcctcttctttaagacctaattcagccattctagcttttaaaacatcaagtctttcttctctttggctaccaccgatgatttcacctattccaggaactaaacagtcagttgctgcaacagtttttccatcatcattaagtctcatgtagaatgctttaatgtcttttggatagtcagtaacgaatactggtttcttaaatatttcttcagttaaatatctttcatgttcagtttgaaggtcgattccccattcaactggatattcgaatgttttaccacagctctttaacatttcaacggcttcagtataagttacttttccaaagtcagaagttactatatgatttaatttatctaataatcctttttcaacaaattggttgaagaatgccatttcttcaggacattcatccataacgtatttaattacgtattttaacattgcttcagctaattccatatcatcttgtaaatcagcaaatgctatttcaggttcaaccatccagaactcagcagcatgtctagctgtatttgaattttcagctctaaaagttggaccaaaagtataaacatttctaaatgctagagcaaaagtttcagcatttaattgtcctgaaactgtaaggttagtttccttaccaaagaagtcttctttgtaatcaacttttccgtcttcagttcttggaacattgtcaaagtctaaagtagtaactttaaacatttcacctgcaccttcacagtcacttccagttaagattggtgtgtttgtatatacaaatccttgatcttggaagaatttgtggatagcataagctgctacagaacgaactctaaatactgcagagaaagcattacttcttggtcttaagtgtgcaatagttcttaagtattcaaaagtatgtcttttcttttgtaatggatagtcagagtctgacattccttcaattacaacttcttttgcttgaatttcaaatggttgtttagcctctggagtttcaactaatgtaccaataactttaattgatgaacttattggtaactttgaaatgtctttaaagttttctaatttgttatcaaaaacaacttgaatatttttaaagaaagatccgtcatttacttcgataaatccaaaagcattagatgctctaagagttcttatccaacctgaaattgttacttctttagataagtattctgatgtgtttctataaagtgattttactaaaactactttttccataataacctcctgttaataaaatatttattatttcaaaattaaataaaagcaataaaaaaatcccttcatccccaaaatatatgggacgaaaggaattacttacgtggtaccacccaaattgcctaaaaaaggccacttagtaaattaataacgacatttagccgtctaagcctaatatttaagtaaataaacttacttaaagttcagttagaaactcagagatgttcttcactattgatttcgtataaggcttacaccatcccttactcgctaaaactaccttcaaaagttactcttctcatcatagtcaataaaagtttgtaattttattaatacgattttacaatactttgctaacatttgcaacttaatttcataatatatatttaaagaatgtttttggaggaaattatggctaaaaaagatttcttagaacaaaagtattgtgaaataaataaactaaagaatttattgcagacatatcctaaggaatatgctgagactattattaaggttatgcaaaatgtttttgatgagataagtgaatacttagatgaagaggctaataagttgaaaaaaatagcaaaaatagatatagcagaaaaaaatatagatatattagaaaaaaaaatagatggattgaataaaaaaatagaaaaaactaagggtcagttatcagaaaaggaaaaatgcaaaaacgtgggaaataaagctaataaagaagaaacaaaggaagataaaaagtcaggaaaaaggcaagattttagtagtagagaagaattaagatattatacaatggatgaagtcgctaaatttgatgggtgtgatggtagtttagcttatgttgttattgaaggaacagtatatgatgtgacagcagttaaagaatggagagatggtaggcattatggattatatgctggaagagatttaacagagtattttaatacttgtcataaagatgaaaaaaacattttgaataaattgaggattgtaggaactattaaaaattagtagttagtagttttagtagttagtagttaaggaataaagtctgcgtaagcagactttaaaatatactttttagaaacttataaggagtttaatccttaacttcaaaccattaactactaattaaactaagttattctttgccagtttcgtatgaagatgtaattgaattaggaaagtttagcatagtgcaatctttcataattcttttatattcatactctaagtatttaaatgtaactttaacttcaccgttattattaatttcaataagagcataagttggatttggttttcctattttaggttttccaacacttccaacattaattaaaagtttattattatactttttggcaaatggaatatgagtgtgtgcacagactaatacgtcaccttcatattgtgacataatttctttggtcttttcatcatcttcaaaaagataatcattaattgcgtttggactaccatgagttaaaagcatatttacaccattaaaagtatattttaatgaggttggaagtgagtctaaatagtatttattagcaattctaacttcttcacaagcccaaggtagtgcaaatgaatttatcgatgtatttctaatataggtaaaatccccatctacgacagaagcatcatagtttccttttacacaaggtatttctcttctttttattagtgctacaacttcattaggatgaggaccgtatccaactaagtctcctaagcatattattttatcaacgttttgttcatcaatatcttcaagtgttttcattagtgcatatatgtttccatggatatctgacataactgctattttcattttgttatcctccaccttttaaattgaaaccctaaatttctatgactctattaaaattaaggtagttattataaaataattatatcactataaagaaaaaaaatacgataaaagttataaataatattatggataatataaaaaatttaagttatgataaaaataagaaaataaaggtacagtatggaggtaaaacatgaaaatttcaagagttacaaagatattagcgcaaatggaagaaagtaaaattccacaattaattataacttcagcagagtcaattttttatttaactggaaagatgattcattcaggagagagattagttgcattatatttagatgttaatggtaatcataaatttcttgtaaataagctatttcctattaatgaagatttaggaatagaagttgtttggtatgatgatattgaaaatccaatagataaattagagaagatagtaaaacaaggagaagttttaggagtagataaagatttaccagcccattttttaatagatcttatgggaagaaatgttgttaagacatttgtaaattcatcacctataattgatagattaagaatgataaaggatgaagaagaaatcaaaataatgaaagaagcttctaagataaatgatgcagtaatgttaaagctttggagtaatttaaaagaaggatattcagaaaagtattatgcaaatcttttatctgaaatttatgaagaagaaggttcttctggattttcattttctccaattatagctacaagtcctaatggtgcagatccacatcatggaactggtaaggataaaataaaagttggagatagtgttgttttagatattggtggaagatataaaaattattgttcagatatgactagaactgtatttataggtaaagaaccaagtaaagagcatgctcaggtgtataacatagtaaaaagtgcaaatgaaaaagctatttctataataaaggaaggagttaaattctctgatattgataaagctgctagaaatttaattactgaagctggttatggagaatatttcacgcatagaactggacatagtataggaatagaagttcatgattttggaaatgttagttcagtaaatgatgaagaggttaaagcaggtatgatattctcagttgaacctggaatttacttaaaagacaacataggagttagaattgaagacttagttcttgtaactaaggatggctgtgaagtattaaattctgttactaaggaaataacagtattatagttttagagtaatgaaaagttaaccatatcataagtaaatgagcttttaatttagaatgttattatgaataaaattaatcaacttactcaaaatataactatattttagataaggggattaattttaaatgtatagtagtatattatttagcacaataattaaaggtattttgatatatgttttagcactgattcttagtaaattaatcggtataaaaattatttcgcaaatgaatttttttgattttataatgggtgtttctgtaggatcaatgattgctaaaattataattgataaggatcatgtagttttttctggaattatagcattaataatttttacaatgttaactatagcaactagttatttaaatttgaaaagttataccgctagaaaaataataaatgctaaaactttgatattaatagaaaatggacgtattattaataaaaatatgaaaaaacttaggatttcaataaatgaacttatgatgaagttaagagaaaaggatgtttttaatttagaggatgtacaatttgcaattatggagagtaatggtcaattatcagttttaataaaagctaataaaaagccaataactccatatgatatgaatttaaaagtaaagagtttttctttaataaatgatattataattgatggaaaaataatagataagaatcttgaaatagctggtatagataaaaaatggttgcactctgaactcaaaaggaaaagtataaataacattgaagatattttttatgccggtatagatcaaaataaaaatcttattatttcagaaaagtatcctgatgattttaatatagaaaataagtttggtatagaataaatgttaaaataattaactgatttactgaaagaagtaagattatataaataacaaagctacacactaatttgtgtgtagctttattttttatattatttcaattactttattcattaattttataaaatcgtttttaactttagcagaagtttcaataacttcttcatggtttaatggttggtctaaaataccagcagccatatttgttaagcacgaaataccaactgttttaattccacagtggtttgcaataattacttctggaacagtagacatacctacagcatctccacccataattctagcaaatcttacttcagcaggagtttcatatgtaggtccagagaacattacatatacaccttgttgtaatttaatttctagttgtttagctgcttctaaaactttatttctaagttctaaactatatgcttcagacatatctgggaatctaggtccaaattcatcgatgttgtgtccaaataatgggtttgaaccagagaaattgatatggtcagtaataagcattaagtctcctgcattaaagctttcattaactgctccagctgcattagttactataagttttgaaacccctaataatttcatcactcttacaggaaaagtaactttatctaatgaataaccttcataatagtggaatcttccttgcatagcaacaacttgtttattaccaagtttacctataactaaacgtccagcatgaccttctactgttgaagttggaaagtttggaatatcagtatagttgtaatattcagcatcttctattgtatcagctaatgagcctaatccagaaccaagtattaatgcaatttcaggtttatacttagtttgttttaaaataaaatcagcagaagctttaatttgtgttaataaatccattaaaatcacctcgtttttttatcttgtagtttatttatttaaaagcatttctcctactttaacaacatctccagcaccaactgtaagaattaaatctccagattttactttagatgctaagtagttagctgcttcttcatggctatgaacattaatgcaatttaatcctgtctctcttatagcatttccaagttcctcagaagatactaatccagtatccttttcacgtgcagcataaatatccattaaaattaattcatctgaagaatcaaaacatgttgtaaactcatcaaaaagagttttagttctagtataagtgtgtggttggaatacgcaataagttttattatgcttaattaactttgcagtagctaatgttgcctttatttcaactggatgatgagcatagtcatctattatagtagcacccttaaattcacctttaaattcaaatctcttatgagcacccttacaattacttaaacctttaataatagattctgttggaatatttaaaattaaagatgtacaaattgcagaaagggcatttaatatattatgcttaccagttgtatttaaagtaacattaaataatgattctccatttttacatacggtaaatgaagcacatcccttattgttgaatgaaatattagtggctgttacgtcacctttagtaaaaccatagcttatagtattacattttgcatattttagtacttcttcaactcttgaatcttcagcacatccaactagataaccatcagatggaattaagtcagagaattttttaaaagtatcttctatatgatttatatctctgtaataatctaaatgatctgcatctatatttaatataattcctatataagggaagaattttaaaaatgatgctttatattcacaggcttctgtaacaaagtattcgctttctccaattttgaagttaccatgaatagcatcaacatctccacctactaaaattgtaggatctaaatctgcacttaaagttatgtgtgaaagcatagaagttgttgttgttttaccatgagttcctgcaacagcaacattatacttatgacctttcattatatagcctaagaattctgctctatccataagttctatattttgatttttagcttctattaactcaggattagtagaaggaattgcagcagtatatactactaaatcaacattttttaagttttcgcttctatgacctatgtaaatttcagcaccagattttcttaatttatttaaaacttctgattctttagcatcggaaccagatactttatatccttttgttaataggacagcagcaagtccactcatgctaaccccgccaattcctatgaaatgaacttttttatttttatctgtatttaaatcaaaagacaagatatcaactcctttaattttattaataaatgtatatttataattatatacaaatttgctaggttgaacacaaaaaataaaaaatatataaaataatttcttataaataggaacaaaattatattaaggatatatttgaaatagaaataaaagataaagagaaaagattatagatataaaataatattaagaatttcaaagaaataaaccaaaacctattgataatctaagtaaattagaataaaatatgaatattcggaatgagaaaattgaaataattcgtgtttttgagaaaataaggaaggtgagtcaagtggaaaaattaagtagaaataatagagttgttgccatcacaaagatattaatagaaactcctaataaggttataggattaaatagattttcggaattattaaacgctgctaaatctactattagtgaagatatagtaatagtaagagaagtcttagaaaaattagaaatgggttcaatagaaacaatttcaggagcagctggaggaattaaattcattcctgcaatgggacaaaaagcaagagaagaatttgctaatgagttatgtgaagctttattagaagagggaagaattgtaccaggtaattttgtgtatttaactgatataatgtataatcctcaaattgtaagtaaagctggtgtaatactagcatctcatttccaagggatggatttagattatatcgtaacagtagaaactaaaggaattcctttagcatatgaggttgctaaaagtttaggaatagaattagtcataataagaaaagacaataaggttacagaaggatcaacagttacaattaattatgtatcaggtacaagtggaagaatacaacaaatggcattagctaaaaaatgtatgaaaccatctagtaaatgtgtattcatagatgatttcttaagaggaggcggaacagctcaaggtataaaagatcttttaagtgaatttgatagtgagttagttggaacaggtgtattagtagataatgttggaatacaaaataagagaactgatgattatgtttcaattattgatttagaatatgataaagaaaataataagcttatagtaaagccatcagagttaataaaatagaattaatgtcagttgtgaaataataaaattttaaaatagtggaaaatttttaaaaaaattaagtaaaaaaaaggatttttaaactttttatagaaatatatttattataaagcaactggaggtgtagtgaagtgacaatcacagacgttagaatcagaaagatagcagcagaaggaaaaatgaaggctatagtttctgtaacatttgataatgaatttgttgtccatgatattaaggtaatagaaggacaaaatggtttatttattgcaatgccaagtagaaagacaccagatggggaatttaaagatattgctcatccaataaatactgatactagggaaaaaattcaaacttccatattaaaagcttacgaagaagcaatggaagaagaaaacgttgttataagtgaataatattttaaataaaaggggtatatgctatttcatataccccttttaatttataattgatttgaagtgttgaaatactttagttaatgcaatataatatataagaaatatgaacgaacgtttttgaaaaaagattgaattttgtccattaaatttattgagaggtgagttaatgtataaatgtgctttaatattagcggcaggtcaagggaagagaataaaatctgatttacctaaggttttacataaagtttgtggaaaagaaatggttaatcatgtaattgatacattgagaaaaagtaagatagaagatataaacgttattgtaggaaaaggtgcagaattagttaagtctaatactagttctagaaatgtaagctattctcttcaagaagagcaactaggaacagggcatgcagttaaatgtgctatggaattcttaaaaggtaaaaatggtacagttgcagtatttaatggagatgcaccacttataaaagaagatacaatagttgaattatttaatatacatcaagaaaataataatagtgcaacaattttaacatctattttagacgatgcttcaggatacggaagaattataagaaatggcgatgaagtattaaaaatagttgaacataaagattgtaacgaagaagagcttaaagtaaaggaaatcaactctggaatttattgctttgaaattgaaaagttagttgagtgtttaggaaatctttctactaacaactctcaaggagagtactatttaactgatgtaattgaaatgttaaaaaataaagctgagaaggtaggagcgcttgtaatagatcatgaagaaacattaggtgttaattcaagattacaactttctgaagttgaagctattttaagaaaaagaataaataataaacatttagataatggtgttactattatagatccaatgacaacttacattggagctgatgtagaaataggtcaagatactattatttatcctggtaatgtattagaaggtaatactaaaataggaaagggatgtacattattccctaactcaagaattaataatagtgtaattggagaagatgtagagatacaatcatcagtaattttggagagttcagttggaaataacactacagttgggccattcgcttatattcgtccagaatctgttgtaggagataatgtaagaattggtgattttgtcgagataaaaaaatctactatagggaataatactaaagtatctcatttaacttatgttggagatagtgaagttggagaaagttgcaactttggttgtggtactgttacggtaaactatgatggaacaagtaaacataaaactataattggaaataatagttttataggatgtaatacaaatttaatttcaccagttacaatagaagataatagttatatagctgccgggtcaacaattacaaatgatgttcatagcggtgaacttgctgttgcaagggctaagcaaaggaatattcaaggctgggtagataaaagaggtcttattaagaaaaaataatataaatatttactataagataaaaaagtggcaagtaatgttgccaatcaaggagggtctcacaattatgatagcacatggaaagaaaattaaaatatttacagggaattcacaccctgaattagcaaaggaaatcgcagatttattaggattaccattaggaaatgcaaaggtttctacgtttagtgatggagaaatttctgtagatattaatgaaactgtaagaggtgttgatgtatttatagttcaatcaacaagttcaccagttaataataatttaatggaattattaattatgattgatgcatttaaaagagcatctgcaggaagaataactgcggttattccttactatggatatgctagacaagatagaaaagcaaaatcaagagatccgataacagcaaagttagttgctgatatattaactgcagctggagcagatagagttttaactatggacttacatgcatctcaaatccaaggatattttaatataccagttgatcaccttttaggttcaccaatattagcaaaaagctttattgaaaaaggatttagcgatcaagaggatgtagttgttgtatcaccagacttaggaagtgttacaagagcaagaaagtttgctgataagctaaatgcaccaattgctattattgataaaagaagaccaaaagcaaatgtttctgagataatgaatattatcggtgaagtaaacggaaaaagatgtatcttaattgatgatatgattgatactgcaggaacaatagcaaatgcagcaaatgcgcttaaagacttaggtgcaaagaatgtttatgcatgctgtactcatggagtattatcaggaccagcatttgaaagaattaataattctgctattgaggagttagttatgttaaatacaattccacttccagatcaagaaggattagaaaagtttaaatcaatttctgtagctccattatttgctgaagcaattaagagaatatacgatgatgaaccaataagtaaattatttgagaactaataagagtaagctgttgtggatacaacagcttattcttttagtttttttaaataatgtgttacaaatgtaaattttattaaaattttattagagttttcaaaaatatagtatagaatattagttaaggaaggtgaatgaaatggatgataagttaggaaaagtattaatagtagatgatgatattcatattaatgagcttatagatatgtatttacaaagtgggggatatagtactaaaaaatgtttcaatggaaatgaagcctgtaatattgtggcgacagaagatattggattggtaatattagatgttatgttaccaggaaaagatggcattgaggtattaaaaaatataagaaaaaatagtgatgtacctgtaataatgcttacagcaaaaggtgaagtattcgataaagttcttgctttagaattaggggcagacgattatatggtaaaaccatttgatccaaaggagttattagctagagttaaggctgtaacgagaagatatatagtagataatcaagctaaagatgttgttaagtattcagatttaactattgatattggagcatatgaagtaacgtatagaggcagcaatgtaaaattagctccaaaagaattagagttactacatttcatggcaaataatccaaataaagtttttactagagaacagcttatgtatgaagtttggggatatgattacccaggagattcaagaaccgttgatgtacacattaaaagattaagagaaaaagttaaaggtggagatgagtgggagcttcaaacagtgtggggtgttggatataagtttgaggtgagataggtgaagaaaaatagcatagtaagaaagcttataataactttttcttcgataactgctggattattaatattagtaggattagttttaactatatggttttataaaaatgattctagggaaacagttgaagcattaaataaacagttagatgttgtttctgaggctgttggtagttatttaaaataccaagaaggaagctatgaagaagttagcagattattggagataacatgtttgactaataatatggatgggattattgtagataggcttggatatgtttatatagtttctaatagtaagtacgactatcttaaatataccaatattgatataagtgaaaataaaatgccggattcaaataagttgcagtacacaaagaaattaataaagaattactcagatgaagatttaggtgcttttataaaacctattttttcaaatgaaaaattagatggatatataattatgcttcaagaggagaaaagaagtgtaaaacataccgtaattattatatgggttgcagttatattagcagttatagttgctgcagctatagtaaagtattttgctgaattactagttgttaggcctatagaagaaatcaataaagctgcaaagaggttagccaaaggtgatgtagatgaaagggttaaggtaattaataatagtgagataggggagcttgctcaatcatttaatataatggcgcaatctatagaggaatctgatattataagaaaagaattcatttcaaatgtttctcatgagctaaggtcaccaattacatctattaaaggttttattggtggaatattagatggtgttatacctaaagataaagaaaattactatttaaaaatagtatacgatgaaattgataggttagcacgattagtaaatgacttattagatatgtcagctatggaatcgggaaaatttaacttgaatatctccgagtttgatattaatcaaacaataagtttgtgtatattaaatttagaaagtaaaatacaagctaaaggattgaatgttaaagctgtttttcatgaaaatcgctgttttgcaataggagatagagatagaattcttcaggttgtaactaatttattagaaaatgctattaagtatagtgaagataatggtcaaatagaagtaaacatatctacaaagggtgaaaaaatatatgtaagcatatttaactctggagatactatttctcaagaggatattaatcatatttgggacagattttataaaagtgataaatcgagaacaaataagataagcacagggcttggtttgcctatagtgagattaattttaacgcaacataatcaagatgtctgggtaaataatgtagaaggaaaaggtgttaagtttacttttacattgcaaggaaatagttaaaaaaagagaaaatattaatttaagatcaaaaattagttttaatattaaaatttaaaatatctatagtgttaatcattatagatattttataaatgcttggaggaagatatgaaatttggaagaggtaaagaaaaaaaaatatcacggactccacaagataggatagctaatataatttttgagaaaaaaaatactactcaagcaagagttaagataggtgttaaaataatcttatatcttgttacagctagttttttaggagcaattatttcaggtataaatgttaaacataaatatggagaagtaatgcaacaagtaaaagagttaaagggtaatgcagataatgttatattagattatacaagagttataaataaggtatctccatctttagtgactattagcgatgctgaagataaacttaatagtgatagttattttgagggaaatgtaacaggaataataattaatgatagtggaataattttaacaaattattcagcaataaaaggaaaaagtgatatttatgtaaagttatcatctgttgcatcaaagccaattaaagcacaaatattaatggaaaatgaaggaatagatttagcaatcataaaaatagaatttgatggagaattaaaagctataaaattagcggatttggataatataaaagaaggacagggaattgttgttttaggaaatgcaattggagacgaatatataggaagttcaattccaggaataataacttcaaaaaatgagaaatgggattccgatgaaaaaaaatattctcttttacaaataaatgcaccaatcgatgaaaaaaataccgggggagctatttgtaactcaaaaggtgaattagttgggattacaaatttatctataacaaatcagaaaaatgaagatggactttattatggattacaaatgaaggaacttcaagaaattattaattcaacaaatagttttaaaagtaccttaggaatagttgaaggtggaatagttgttgataaggaaagagaatttagtggattttacatacaagaattgtcaaaggatggcagtgcatatatggctgggattaaacctacagatataattgttgagattgatggatatgaagttgtagaggttgatgatatgatatcaatattgcaaggagaacaaaaagatgatatattacattgcaaggtcttaagtgacggtgaaatgaaagatgtggatattaaaatattaagatagataatttggactaattctaaaaggaattagtctaaatttttgttgaaaagaatggagatattaatacagacaatgattaaaaaaacttttattattgaaaaaaatggtataatataaaataggctaatttaaagtaacggaggagtttaaatgtttttaattgttggattaggaaatccaggtaaagagtatgatggaacaagacataacataggatttgctgcaatagattatatagcagataagtataatatagaattaaataggataaaatttaaaggtatatttggagagggattaataaatgggaagaaggtaattttattaaaaccgactacatatatgaatttaagtggagaaagtattagagaagtagttaacttttataaaatagacaatgaagaaataattataatttatgatgatattagtttagatgtgggaagactaagaataagggaaaaaggaagtcatggagggcataatggaataaaaagtattatagctaatttaggtagtgacgtttttccaagagtaaaaattggtgtaggtgaacctaaggggaatttagtttcacatgtattaggaaagtttagtgatgatgaagttcaaatattaaaggaatcaataaaagcttcaagtgatgctgtaagtataataattactaaagatactaaagaagcgatgaataaattaaatggttttaatgcgggtaaagagaagtaaatagggaatatggaaggtgatacaatgaggttacaagggctattgcaacccttaattgaaaatgaaaaatttattgatatttcgacgggattaaaggcgaacgcttttccaataaatattgttggtttatcagaatcaggaaagagctatattatagattctatttttaatgaaatagataactcgctagttatagtaacacataatgaaatagaagctaaaaatttatatgatgatttaagtttttattcaactaatgtgtattttttacctataagagaagttgtgttttataatgtagatgctatttcgggtgatttaagatgggctagattaaaggttataaaagaaatacttaataataaagctaaaaagataatagttacttctatagaagcaatgacagcattatatacacctagagataaatatttaagttacagtattaatataaaaaatggtgatgaagtagacttaaaagatatttctaataaattaattgagtgtggatatgaaagagttgaagtagtagaaggaaaaggtgaattttcatttagaggagggatacttgatgttttccctcctatagccgtttatccatatagagttgaattgtttggtgatgaaatagattcgattagaacttttaatatagaatcacaacgtagcattgaaaaagttaaatctattgaaatttttcctgcaaaggaagttattgttgatgaagaagcgaaaaaaagagctaacgatacaattattagtgaattaaattctatattagaaaaagcaaataataaaagtaatgatcaaattgagaaaatatcaagaatagtaaataaaaatttagagatgttgaatgaaacatctacttttgaaactgttgatagttatttacctttcttttatgagaagtcagagtcactttttgattatttagagggatatacatttgtaattgatgatttaaaaagatgtgaaggaaagcttgaaagtatatactatgaatttaatgaaaattacttagcatttcttcaaagaggagatattttgccctctcaaaataaattgcttattgacaaaggtgaattattagttaatttagaaaagtcaaaagttattactttaaatacatttgaaaatcaaacagatatattatatccaacaaaaaatattgagtttaagcaaattacatcaaatacttataacggacagcttgatttattaattgaagatataaaattaagaaaagaaaatggatatagaacgttaatcttagctggaactagaactagaggtgaaaggttagtaaagacgttaagagatagagatgtagaaagtgtttataaagataatgttgactcaattgaattagggcaagttgttgttacttttggtaatttagtaaagggatttgagtatccagatttaaagctttgtgtaatatcagataaggaagtatttggtgaagctaagaaatctcttcctaaaaaaagtaacaagaaaaagggtgttgggaagattactagctttgcagagttaaaaccaggcgattatgttgtacatgcaaatcatgggataggtgtatttaaaggaataaaacaaattgatattgcaggaaatacaagagattatttagatattgtatatgataagggtgataagctttatgtgccagtagatcaactagatttggttcaaaaatatattggtagtgaaggtaagagtcctaaagtaaataagctaggtggaaatgagtggcaaaaggctaaagcaaaagtaagaaaatcgataaatgaaatagctgaagatttagtaaagctttatgcagctagagcagccctaaagggatataaatattctaaggatactgaatggcaaagacaatttgaagatgagtttccatatgaagaaacagcagatcaattatcatcattagaagagattaagcatgatatggaatctgataagccaatggatagattgctttgtggtgacgttggatatggaaaaacagaggttgcaataagggcagcatttaaggctgtgatggatgggaaacaagttgcatttttagttccaactacaatattagcagagcaacattataaaaatttagttaaaagattttcagattttccggttaaaattgatatggtaagtagatttagaacagctaagcagcaaaaagcaacattacaggcgttaaaagaaggaaatgttgatatattaataggaactcacagattagtatcaaaagatattgtttttaaagatttaggattattaatagttgatgaagaacaaagatttggggttgcacaaaaggaaaaaataaaatcaattaagaagaatgttgatgtactaacattaagtgcaacacctattccaagaacacttcatatgtcattaacaggggttagggatatttctgttattgaaacgcctccagaagagagatttccaattcaaacttatgttgtagaacaaaatgaccagcttattagagatgctatattaagagaaatgtcaagagatgggcaggtttattttgtatataatagagttgaaagtatacaaggaatggctcaatatattagtgagttagtaccagagtgtaaggttggaataatccatgggcaaatgactgaaaaagaattagaatctgaaatgattaagtttatgcagaaggaatatgatgttctagtctgtacaactattatagaaactggtattgatattcaaaatgtaaatactatgatagtaaataatgctgataagatgggattatcacaattatatcaattaaggggaagagttgggcgttctaataaaattgcatatgcatattttatgtatactaaagataaagttttaacagaggttgctgaaaaaagattaaaagcattaaaggactttactgaacttggatcaggattcaaaatagcaatgagggacttagaaataagaggagccggaaatatgatgggatcatctcaacatggacacatggcagctataggatatgatttatattgtagaatgcttgaagatacagttaagttaattaaaggcgaaatagaacaagagccaattgaaacgacagttgatattaaaattgatgcatatattccatcatcatatattgaagatgaaattcaaaaaattgaagtttataaaaaaattgctgcaattgaaaataaggatgattataatgacataaaggatgaattagaggatagatattcatcaattccggaagcggtatacaacttaatggatattgcatatgttaaaagtttagctaagatattattaattgaagagataaaagaaacacctaaagaggtaagatttaagttcccaaaaggatataaaaaggttaatgatatttatcataaattaatgaaaaaatataaagaaaatgttgtgttatactttggagaaactccattttttgcggtaaaagtgaatagtattaagcgtgaggaaatattagatttttataaaaagcttcttactgacttaattaaaaattcacgtaaaaaatagatagtagaatttgaataaaaaggatataactgatatactagggtatataacaaattattatgaatgtaaagtgagggaaataaattgagaaatataaaaaatatagtagctatcgcaacagttgctgttatggcgttttcaatggctggttgtaagatgatagaaaaaactccggaagctatacaaaagactgtactagcaaaggttggaagtgacaaaattactatggctgatgttaatagcgaattacaggctgatatagactatttaattgaaacatacggtgaagattatgaaaataaaatagatgatacattaaaagctaaattaaagagtgcaagacaaagtgttcttgaacaattagtagatgataaagtattaattactaagggaacagaacttggatatattccatcagatgatgaattagcaactgagatagaaactgaaagacaaaactttgttgaagcttatggcggagaagatggattacaagaagcattagaatattacggaatgagcgatgagaaatttaattcattccttgaaaatttagtgaaagttcaaaaggttactgatgcaataacagcagatgtaactgtaactgatgaagatattgaaacttattataatgaaaatatagctaattatactaaaaaagctggagcaaatgctaaacatattttatttgaaacagaagaagaagcacaagcagctaaggataaaataaattctggtgaagctacttttgatgagatatatgcagaatatgaagctaatgcaacttcaggaactttcccattatcagaaaatttaggatatgttgaaaatgaacaagaaaactttgatactgacttcttagctggatttaaggtattaaaagaaggtgaaatttcagatcctgttcaaagttcatttggataccatataataaaggttgatggagttcaaactgaagatacagtaactccacttgatgaagtaaaagattctattaaatcaactttagagagtaagaagaaagaagaattatataattcaacattagaacaatggaaaaaagatttaaatgttaaattatatgaagatagactttagtttctagtgaaaagccaaacaagatttttataatcttgtttggctttttttattattataaataataaattgaattttagggaaatttattagtggagatatggaagatattattttaaagtttcataattgttatttgaatttaataattggaaaattgccatagacttcatataattcctctttagatagtagaggataaatattgggtatatgtgtataaaatttctaatacttcaaataataataatgcagttaatcatataacataattaaggaggtaactcatagtaatgaaagctacaggaatagtaagacgtattgatgatttaggaagagtagttataccaaaggaaataagaagaacattaagaattagagaaggggatccattagaaatatttacagatagagaaggtggtgtaatcttaaagaaatactcaccaataggagaattaactgatttctctaaggagtatgctgaaagcttgcaacaagcaattggacatattgttttaattgctgataaagatgcctttatatcagtaagtggagcaacaaagaaagattatattgaaagaaaaataagttcagagttagaagctataatggatggtagaaaaccttctatcataacagataatggtaaaacaattccgttacataatgatgaggaaccaggagaatatacaagccaagtaatagcaccaataattgctgaaggagatgcaattggagctgtacttattgtatcaaaggaatctggagatgtatttggggatttagaattaaaattagctgaaactgcagcgtctttcttaggaaagcaaatggaacaataaataatactaaacatattacaatatttgttgaacaattatacaatatttgtaataatacctctaagctttaaataaaaattagtagtagtcagtaatttgagtttggaggtattttatgaaaaagcaatctcttataaaaggaagcttagtattaggagtggcaggaatgttagcaaaagtattaggctttttctttagatggccattaattatgttaattggtgatgaaggaatagggtattatcaattatcatatccgttatacatgttttatgtaggaatggcaagtggggttccggtagcagtttctaaaatgatatcagaaaaaaatgctgttggggatgttgaaggtagttatgaagttgttaaagaatcttcttttttgatgataacattaggcgtaggtacttcattaatattattcttctttgcaaagccaattattagtttcttaaaatgggatatgaaatcttattattcattaataggtatatcttttgcaccaatgatggtttcattcgttactatatttagaggtttctttcaaggtcttcaaaatatgacaccatctggggtatcacaggtattagaacaaataggaagagtgataattggagttggactagcctattttctttttagtaagggggttgaatattctgcaggaggagcagcttttggagctgcgggaggagcttttattgcaggaatatatttgattataaaatatagacatgtaaaaaaagaaatgggaataagaaaagttaaaactaatccggaattattaagcaaaatattaaagattgcaataccaatttctattggtgctacagtgggaacgataatgaatttaattgattctatattagtaccacaaaagttgattgaatcaggggttgtaaatgcaacggctttatatggacaacttactggtaaagcagctgtgttagttaatatacctttaacattatcagtagcaatttgtacatcattacttccgataatagcagaaaactatatactaaatagaaaagaagaaatgcaaagtaaaattaatatcgcaatgaaattatcagcagttattgcattgccagctacattaggaatgttttgtttagcaggacctataatgaagttagtattttttgataggtatgaggggattgaaatattaagatatctatcactatctataccttttgttattgtaactcaaacaacaacttctgttttgcaggcaacaaatcattatataagacctgttataaatctagtaataggatgtattgtaaaggtaattttaactacaatattagtgccgatgccagaaataaatatttttggggctgtaatagcaagtgtttctgcttatgtagtagttactatattaaatcttatagcacttaaaagtaaaattaaatgtaaagtaagcatttatgattcatttataaaaccagcatatgcatcagttgtaatgatagtagttgttttatttagctatgattttattatgaaaaaaatagacagtaacagtatttcttgcttattatcaatatttatgggtattattatatatataatagctattctactttttaaagtgtttaatgttgatgaaataaaaaatagattagtaagaaaatgatataaggagagtactgtataatgataaaaatagttggattaggacctggttcaccagatgctttaactataggagctgtgagagctttagaggaaagtaaaaatctttattttagaacagaaaagcatcctacagttgattatttaaaaaagggattaacttcttttaagacttgcgataattattatgaagaaggaagtagttttgatgaggtgtattctaatattgcaaatgaaatgatagaagaatataaaaagtgtggcgaactagtttatgctgttccaggacatcctttagtagcagaaagatcagttttaaatcttattaacttatgtaatgaaaataatatagaatacaaaatactacctgcagttagttttgtggatgctatgatggataggctacaaattgatccaatagaaggactaaaaataatagatgcatttgatataaaaaatcaaatattagataaaagaattggtactataattactcaagtatataatgtattaattgcttctgaagtgaaacttgagttacttgaatattataatgatgaaacagagatatactatgtaagagcagcaggaatagaaggagaagagtctataagaaaaattcctctatatgaattagatatgcaagaagatatagattatttaacttcagtatatattcctaaagatataaataataaaaaggatttttatgatttaattaatacaatagaaactttaagaggcgaagatggatgtgcttgggatagagaacaaactcatgaaagtattaaaaattctcttatagaagaagcgtatgaagctgtagaagctatagatgatgataatatagatggattaatagaagaattaggcgatgttttattacaagttgtattccattctgtaattggaaaagaagatggatattttaatatatctgatgttatagaagcaataacttcaaaaatgatctatagacatcctcatgtttttagtgatggagttgctaattcatctaaagaagttttagaaaattgggatgaattaaagagaaaagaaaagaattatgaaactctgtctgaagaaattgaagggatagcaaagacgttacctgcattaacaaaagcacataaggtgcaaaaaaaggtttcgaaggttggctttgattttcaagatgtaaatgaagccgttaaaaaaatagaagaagaaataaatgaagtactagatgtatataaatccaataatatggaaaaaataatagatgaagttggtgatttattatttgcttgtgttaacgtagctagattattaaatgttgatgaagaagaagcactaaataaatcaatcaaaaagtttgttaaaagatttaaatttgttgaggaaaatttattaagacaaaacaaaaatttaaatgaatctacattagatgaaatgaatgctttatgggaagattcaaaaaaatacgattaatagaagagatatagaatttctgcagctttagaaggacttttatagtttatgcagaatattttaagaagaggaatataaaaaatgactatactacaagaaaaagttgtaataaatatatttttatagaaaaaagcccgtattactatagactactgaataaagtggatatataataaggtaatgtagttatagtacataattaaaaatagttaactacaatatttttaactgtttatttaaggaggatgtaaatcgtgaataaagcagaattaattactagcatggcagaaaaaagccaattaacaaagaaggatgcagaaactgcattaaaagcattcattgattcagttcaagaagctttagaaaatggtgaaaaagttcaattggttggatttggtactttcgaaactagagaaagagcagctagagaaggaagaaacccaagaactaaagaaactataaacattccagcttctactgtaccagtatttaaagcaggtaaggaatttaaagaaagagttaataagtaattataatttttaagcccgggttatctcgggttttttaatacctaaaattaatgaacttatgtggaggatataatatgagattagataaatatttaaaagtatcgagaataataaaaagaagaacagtagctaaagaagcttgtgaaggtggaagggtttcaattaatgataaggtggcaaaaccatcaactaatataaatgaaggcgatataatagaaattacttttgcaaatagaaagcttaaggcaagaattattaatattgctgagcatgtgagaaaagaaaatgctaaagaaatgtatgagattttagaaggtgtagaagatcaagaataatttttgatgatacttcatatatttaatcaagaaatatatggaggagtaaataatggagaaaaaattagagggtaggatagaggataatagaggaaatattatattagaaaatagaaagaaaatgacattaactggagtagaggaagtaattagttttgatgatgaaaaaatattactcaatactaaacttggggcgttaacaataaaaggtcaaaatttgaaaatgaataagcttgatgtacaaaatggtgatgtaatgattaatggagaaatatattacatcgtttatagtggaaaagaagttaaaaaagaaaaggaaagcataattggaaggcttttcaaatagggggttattatgccattaaaaacagatgtacaatttagtatcatactttacgcaatgttagctggtatattaacaggagcaatgtttgatttatatagaataataaggggtagcaatgtaaataaaattgtaattgctattgaagatatattgttttggatattagcagctatggctgtttttgcattcctcctttatactaattatgcatttttaggagcttatgtttatatatttatgattatttctttgaccttatacataaggtttattagtaatatatgtattaaatttgagttgagacttataagtgcttcaggaaaaatatttagagtaatatttaaaaattttatttatccatttaaagtaatatttcataatattacaggaaaaaacaattagtataaaaaatatcttgaattaattatgtagagtggtttacaatatatttatagaataatataaagagggtactattttatgaaaaaaagcgtaaaccttaaaggaattattattgttttagttattggaatttttggtataagtgtaataaaacaagtaactgtactaagaagaataaagaatgatatttctattcaaactcaagagttagaggaattaaaagaaaaaaatattaagttgcaagctgaattagatagggcacaaagtaataatgagtatctagaaaaactagctagagaaaggttaggattaataaaagaaggtgagcaacaagttattccaagtaaagaagcagaatagtattggtttaagtttaaatttgtattaatatggttattattattaatgacatagattattttttattttaaggaggattctttgtaaaatgaccttaatggcaggaaacatattagaaggtacagtggtaaatattacaaacttcggagcttttgtagagatagaaggtaaaacaggtttagttcatatttcagaagttgcagattcttttgttaaggatataagacaacatcttaatgagcaagataaggtaaaggttaaagttatatcaattgatgataatggaaaaattagtttatcaattaagcaagctaatgttaagaaaaaatctgtaaagccagcagaaatcgaatggacatctgaaaagaaaaaggttgcaccagcaaactttgaagatattatgtctagatttttaaaggatagtgaagaaagacaacaagattttaaaaagcatcaagagtttaaaacaagacctaaaagaagtttttaattagaaccgttatataagttttatatattagagagaatggataatgaattatcgttctctttttttattatatttttttaataaaaaaagagaataatataaaaagtatataaaatcaactaatgaaaagtggctattttactggctttagatagaaattaaaataaaaaataaaaaaagtgaaaaaaatgttgacagtattaagttcatactatataattaattttgtcgtcagatgacggcggcaaaataaatatgctgaagtggcggaacaggcagacgcacaggacttaaaatcctgcggtagcgataccgtaccggttcgattccggtcttcagcaccaaactaaattcaactttaatatcgcggggtggagcagttggcagctcgtcgggctcataacccgaaggtcgtaggttcaagtcctgcccccgcaaccaacatggcggaatagctcagctggctagagcactcggttcatacccgaggtgtcgtaggttcaagtcctatttccgctaccatatacgctgaagtggcggaacaggcagacgcacaggacttaaaatcctgcggtagcgataccgtaccggttcgattccggtcttcagcaccaaactaaattcaactttaatatcgcggggtggagcagttggcagctcgtcgggctcataacccgaaggtcgtaggttcaagtcctgcccccgcaaccaaacatggcggaatagctcagctggctagagcactcggttcatacccgaggtgtcgtaggttcaagtcctatttccgctaccatatacgctgaagtggcggaacaggcagacgcacaggacttaaaatcctgcggtagcgataccgtaccggttcgattccggtcttcagcaccaaaagagatacaaagaaatttgtatatctttttttatttataaatgattaaaactatctaaattaaaagtatattgaagataattaataatatgactgatagtaataaaaaaatattgattatatgcgacaaaaatacaacttaaatatcaaaaaagttaaagtaaaaataaccctagatatttttaagatgtaaataaagagtgtaaaaagaaaaatataaaacattcattggaaaaaaaaggataattgtcttacgaatttaagatttcataaacattaattgacataactctaattataatagtgctattattttagtaggatttttaagaggagattgatagttatggattatggagtagaagtacctagctacagaagagtagatagtgaaaagaaaacaaaaaaattagattttgaaaatggattagtaggattattagtagtattgatttcgggagttatgataagtagagttggattcggatttgttgaaggcttatatttagctccttttggaatagggtattttttatctatggtgaaaaaaagtgatattaagaaactaattttagtttatttgtcagttagtgttggatatcttataggatatagcaagagtaaagatataataatttatatttctatagcaacagcaatattattatgtaagattatatgtaatgctattaataaagagttcaaaaatagtatagcttttttggctgttattgtatccactttagcaataggtttattcattggggagcaaagttttgaaattaatttaattttttctttaactaaagccttattaataataccagtattttatatgctaaattatggaattggttgtatgcaagaattaaatacaaattacttttactcaacagaagagttgataagtatagctattttaagttgcttagtagtagcaggtataggaaattttacgatattaggagttggaataagaactataatagctttagctatggtgataacaatagcatacgcagcaggaagtaatgtgggggctatattgggagtaacaatgggaataataataggaattgctaataatgatttgcttatatcaacaactatgtattctatttgtggattaattgtgggtgtatttaaagaaactgggaaaaatttttcgatattagcttatattatatctatgtttatgatggaagcatatactggtcaaataagcgttcagtcaggtgtagaagtatgttttgcggcagtaattatgtttattattccggcaaatgttatcaaagaaatcttaagagagcttagtaatgaagagaaaagtaatgtaataagtgatgcacaggttgaaggtattaaattagagtttgtagatagattagaagctttgagaggatctttatcggctgtagcaacatcaattgaagatttatcaggaaatgaaaaattacttatgaaaaataagggtactgctatgatagaaagtttggctgatagagtttgtcaaagttgtgagatgaatagtaaatgttggggaagagaattgcatagcactttttcggattttggagagcttatgctaagttgtgaaagtaaaaaggtatacttacctaaaaatttagatttaaaatgtgtaaaaagaactacattattaaagagtgcagaggacttattttcaacctatacggttaatgaagctttaaaatctagactgatagaaggaagaaaagttatagcaaatcaaataaataatatgtctataacagtatcaggaattcttagcgattttaatagtaatgtaaatagttgtctagaaattgataaagtattaagaaaaacattgtctaaaaataaaattagatacaataatatttattcttatactgatagaaaagggcgtttaaagattaaaataaaaatagatagttatgatggtgaaagttactgtagaaaatatatattgcctattattagcgagtttgtaagaacaccattaagtatagctcaagatggatgtactgttgatccagatactaatgaatgttcaatagttatggaggaaacttgtaagtataatgtttcttcatttgtagcttttaatgttaaagatggagaaaaatattcaggagatagttatagttttggtaagaataaggtaggtgagtatgtaactatattaagtgatggaatgggctcaggaccagaggctggtttagaaagtgaagcagctattgagttgatagagaaatttaatgaaggtggatttagtgaagcaactactttaaatgcagtaaattctattatgggaatgaagtttagtgaagatgaaaaatttactacattagatatgaattcaatagatttatatacaggtgaagctcagtttataaaagttggagcaagtatgagttttattaaaaggggtggagaagtcgaagttgttgatagtgccagcttaccttttggtattgttgatgatattgatatcaagcctattaagaagaaggttaaaaatggagatataatagtgactattagtgatggtgttatagatattgataaagataacgttggggaatatgcttggatagttaattatttaaaatgtgaacaagtaaatccagaaattttagcaagagaaatattagaacaagctaaaagaaaaagcaacggaagagttttagatgatatgacggtagtagtttcaaaattatattcaacttattaataaaagtgctcttaggagcacttttattatcctaataataaatttaaatttgaaataaatgtatataatgtttacattgaaatatggtaaatgtattatatatttataaatatataaataggagaatataagtgttagataaagtaataaaatatataaacgataatgaacttattcaaaatgaagataaaatattagtggcgttgtcaggtggacctgattctgtgtgtatgttacatatattatataaattaaaagatatacttaatatagaattaggtgctatacatataaaccatatgttaaggggggatgaatcagataaagatgaaaaatatataggtaatttatgtagtcaattaggtataaattattatgtaaaaagaatagatatagagtatgttgctaatgatactaatgtttctttagaagtggctggaagaaatgaaagatacagggcttttgaagaaataagatcaaggcatgggtacaataaaatagctgtagcacataatgcaaatgatcaggctgaaacagttcttatgcgtatgatgcgaggaactggacttgaaggattaacaggaattaaatcaaaaagggaagatggtgttataagacctatattatgcttagatagaaaggaaatagaagattattgtgaagaaaataaacttaatcctagaatagataaaagtaatcatgagagaatctatagtagaaataaggttaggttagatataattccatatatgaaagaacattttaatgaagaaatagttgaaactttaaatagaatggtatcattattacaaaaagataatgagtttatagaagaatattctaatgagtgttacaataaatattgtaaaattaaagataaacaattgagagtagaaaaggaattattcgtaaaagaaatggaggctgtagttactagagttgtaataaaggcatttaaggaaatttctaattgtcatcagaatttcgagatgaagcatatatatgagattgttaatttagctaaaaattcaacaggaaagaaaataaatttaacgaataatataatatgtgaaaactcatatgggaaccttatatttaaggtaaatgaaaaaaatattatagattataaggttactgaagtacgaataaataaaagtaatattttaaatgatattgaatttaaaaattataatgttagttttcaaattattaacaataaaagtaaggtagaattttctaaaaatagcttaataaagttatttgattatgataagatagaaaaagagattataattaggagtagaaaagatggggataaaattattcctttgggaatgaaagggaataaaaaacttaaggatatttttattgatatgaagattccaagggagcaaagagatgaaattcctattttatgctttgatgaaaaaattgcctgggttgttggatataaaacttctcaagaatcaagaataactcaggatacaaaaaatatattaaaaattacgtttgccagaaaggaatagtgacaatgttacaagatattaaagaagtgttatttagtgaagaggctattaataagagagtaaaggaattagcgtcaagaattagtgaagattacaaaggaaaagaattattagtggtaggtgttttgaaaggttctgtaatatttgcagcagaattaataaaaaatataactattccttgccaaattgattttatggcagtttctagttatggagattcatctgaaactactggggttgttagaatacttaaggatttagatagtgaaatctcaggaaaacatataattatagttgaagatatagttgatagtggagttacattaaattatttattaaattatttaaaaagtagaaatgctagctcagttgaaattgtatcattattaactaaaccatctagaagaaaggttgatatagattgtaaatatattggctttgaaactccagatgaattcttagttggatatggattggattatgctgaaaagtatagaaatttaccttttgtaggaatattaaaaagagaggtttatgagaagtagattattaaaaaaacaaaataataaaaaactatgagaaaggggggccttgaatgaagaaatattcaagtgctactgtatggataatagctataatattattattttttgcagcatcatttcttttaaggggagaaagtggttctgatagaatagtatttagtgatttccaacaaaagtggataaatgacgaaattgaaagtataagagttgatcctgataagatgctcgttactggacagacaagagatgaaaagaattttacagtgtatgcaccagatacaatggtggaaatgttaaatagtcaatatgcaaaaaatgatattaagatagaatatgctgcgccatctaataatagtgtgtggcttactataatacctatgggaatgataatattattatttgtagtgtttattttcttctttacacagcagtcacaaggtggtggaagtggaaagggagtaatgaattttggaaaaagcagagctaagatgatgtctccagatgccaagagagtaacttttgatgatgttgctggagcagatgaagaaaaggctgaactagaagaaatagtagatttcttaaaggctccatctagatatattgaaatgggagcgagaataccaaaaggtgttttactagttgggcctccaggaacaggaaagaccttattagctaaggcaattgcaggagaagcaggagtaccattctttagtatatcaggttctgattttgttgagatgtttgttggagttggtgcatcaagagttagagatttatttgagcaggcaaagaaaaattcgccagctttaatatttatagatgaaattgatgctgtaggtagacaaagaggtgctggtcttggtggtggtcatgatgagagagaacaaactcttaatcaattactagttgaaatggatggttttggagctaatgaaggtatcataatgatagcggcaacaaatagaccagatattttagatccagcgttattaagaccaggtagatttgatagacaaatagttgttcaaagaccagatagaaaagggagagaagctgttttaaaggttcatacacataaaaagcctttagctgttgatgtagatttagaggtgttagcaaagagaacaccaggatttagtggtgctgatttagaaaacctagctaatgaagctgctcttttagccgtaagaaaaaataaaaaggctataggaatggatgaatttgaagaagcaataactagggttattgcaggtcctgaaaagaagagtagggctattagtgagcatgatagaaagcttacagcttaccatgaagctggtcatgcggttgtgatgaagtgtttaaaacattcagatccagtacatgaaataagtattataccaagaggtatggcgggtggatatactatgcatttaccaaatgaagatagagcgtatacttctaaggagaaactacaagatgaaatggtagggcttttaggtggtagagttgctgaaaagttgatattaggtgatataagcacaggagctaagaatgatattgatagagcaagttcaatagcaagagctatggttatggaatatggaatgagtgatgaaattggaactatttcttatggttctgataacaatgaagtattcttaggtagagagcttggaagaggaagaaactttagtgaggaaattggtgcagaaatagataaggaagttaagaaatttattgaagtagcatatgatagagcagaaaatcttcttaagactaatattaataagcttcatgcagtagctaatgaattgcttgataaagaaaagatagatggaaaagaatttgaaatgatatttgatgcaaattaaaagtagccttagggctactttttttatgataagttttaagtgggattaataaatttagcttagttagaatattaaaaggtatagtttaggtggggaaagtattttgatgtaagctgactttttgtttattaattcttatttaaaagaaaagtaataaaaacaaaacacgaatatttaaatagaaaattacaaaaatgttcgaaagatgtttaaaaaaggaatttatagtgatataattaagtatacttaaaatttgaaggtattagggaggtttattatatgaaaagtgatattcaaatagctcaagaagctaaaatggaacctatagttaagattgcagaaaaactaaatttaggtgaggatgatatagaactttatggaaagtataaatgtaagatttctttagatatattaaataaaaataaagataaaaaagatggaaaattagttcttgtaacagcaataaatccaactccagctggagaaggaaaatcaacagttacagtaggtttagggcaggcactatgcaaaactggaaaaaaagcagttatagcattgagagaaccttcattagggcctgtttttggggttaaaggaggagcagctggtggtggatatgcacaagtagtacctatggaagatataaatctacattttactggagatatgcatgcaattactacagcaaataatttattgtgtgctgctatagataatcatattcatcaaggaaatacattaagaattgattcaagaagaatcatatttaagagagttatggatatgaatgatagagcgttaagaagcatagtagtaggaatgggtggaaaaataaatggttttctaagagaagatggatttatgataacagttgcttcagaaataatggctattctttgtttagctactagtttaagtgatcttaaagaaagaatgggaaatatattaatagcatatgatttagatggaaatccagtttatgcaaaacaattagatattcaaggagcaatggcccttctaatgaaggatgctgttaagccaaatttagttcaaaccttagaaaatactccagcaataattcacggaggaccatttgcaaatattgcacatggatgcaattcaatacttgctacaaagatggcacttaaattaggtgatgtagtagttactgaaggtggctttggggctgacttaggggcagaaaaattcttagatattaaatgtagatatggtggattaacaccaaattgtgtagtgattgttgctactatgagagctttaaaacatcatggtggtgtaaaaaaggaagatttaaatactccaaatgttgaagcagtagctaaaggaatagttaatttagaaaagcaaatagaaaatatgcaaaagtataatattccagtcgtagttgctataaataaattcttaacagattctgatgaagaaattgaatatataaagaatttctgtgataaattaggtgttaaggttgctttaagtgatgtttgggctaaaggtggagaagggggattagaattagctaatatagttaataatatattagaaaatgaagaatcaaactttaaagttttatatgatgaaaagagtagtattaaagaaaaaatattaactattgccaaggaaatttatggagcaaatgatgtaagatatactccggcagcaaataagcaaattgcagaattagaaaaatttgaattagataaattgcctatttgtatggcgaaaacacaatactcattatcagataatccagcactactaggtagaccagaaggatttgatataactgttaaagaagttagagtttccaatggagctggatttatagtagcattaactggtgatattatgacaatgcctggtttaccaaaggtaccagcagcaaatagaatggatattttagaaaatggcgaaattgtaggcttgttctaaaaaaataaaaatttacaacacttgacaaataacatgtaattgttaaaattaaagtattagtttaaattactgtttatagtacaataaaagcagctttagggctgctttaattatgttaaggtggtgtgcgtttatgattctactggtagatgtagggaataccaacatagttataggagtatgcaaaaataatgagtatatagctggttggagaatttctactgattctaaaaaaacttcagatgaatatggtattcaaatgatacaattattccatcaaagtgatttaaatccaaaagaagtaaaaggaataataatttcttcggttgtacctaatataatgcattccttagaaaatatggttaagaagagttttaatatagatcctataattgttgggccaggtgtaaagactggaataaatattaaatatgataatcctaaggaagttggagcggatagaattgtaaatgcagtggctgctcatgaaatatatagaagagatgtaattataattgattttggaactgcaactacgtattgcgctgtcactgaagaaggaaattatttaggtggatgtatttgtccaggggtgagaatttcttcagatgccttgtttgaaagagcagcaaagttacctagagtggagttagaattaccaaagagtataatatgtaagaatactgtatcaagtatgcaagcaggtatattatatggatatatagggcaagtagaatatatagttagcaagacaaaaaaagagatggttgcacttggatatgaaaatccatatgtaattgcaactgggggcttagctaatttaatagctaaatcaacaaatgtaatagataaggttgattcaagcttaacattagaggggttaagaataatttacgataaaaataaggagtaaacaaatgaaaataggaaaccttaatttggggaagagtgttttcttagcacctatggcaggagtaacggatatttcatttagaggattatgcaaggagatgggatgcggattagtatacacagagatggtaagtgcaaaagcattatattatggaagtgaaaatactaagactttattaagaattgcagatgaagaaaaaccagtagcagctcagatttttggaaatgatcctaagataatggcggaagttgtacaaagctattttaacaatatagatgatatatgtattttggatataaatatgggatgtcctgcacctaagataactaaaaatggagaaggttcggcattaatgttaaatcctaaattagcaggagagatagtaagtgaaattaaaaaagtttcaaagaagcccgttactgttaaatttagaaaaggatatgatgagcataatattaatgctgttgagtttgctaaagtaatggaatattcaggagcagatgcaattgctgttcatggaagaactaaaaaacaaatgtatgaaggaaaagcagactgggatataataagtaaggtgaaaagtgctgtatctataccggttataggtaatggagatgtgttcacaccggaagatgcattaagaatgaaggaaataactcagtgtgatgctataatgattgcaaggggaagtatgggaaatccatggatatttaatcaaatagaacgagtattaaatggtcaagaaattttacctattacagcagaagagaaaataaatatgtgtttaaggcattatgaattagctattaaatatgatggcgagtttaaggctgtaaaagaaatgagaaagcatgcttcgtggtatctaaaaggattacccaaaagtagcgaattgagaaatatagtaaatacgttatcaacaagtacagaagtgtttaatatattgcaagaatataaaaatgaattaaagaatatttagatatatgtattatctagtgaaattttgtgaaaacaatacgttgaaaatagtcagctattttattgacagatgaaatagcctgatttataatatttaaaatgattttaagattactaaacttacctatttatgagttgaatacggttaagttttgaaggggagaaagattatgagtcaagcaaaaaaatttataatgacttacgaaggtgttaaaaaacttgaagaagaattagaatacttaaaaactgttaaaagaaaagaaattactgaaaaaataaaggtagctttaggatatggagatttaagtgaaaactctgagtatgatgaagctaaaaacgatcaagcttttactgaaggtagaattattcaattagaaaacatgttaaaaaatgcagttgttgttgatgaaaatgaaataccaaaggataaagtttcagtaggatctatagtaaaggttatggattacgaatttgatgaagaagttgaatatacaattgttggttcagcagaagcagatccaatgaattttaaaatatcaaatgaatcaccagtgggtagtgcattattaggaaaaaaagttggagatgtagtagaagttacagttccaagtggagtaagtaagtttgaagtcttagaaataagaagagactaattggaggtatagtgaatgtcaactgaagaaatgaacatgcaagaactagagtcacaattcaatgaacaagaaagattaagaagagagaagctagttcaattacaagaagagggaaaagatcctttcgatgtatacaaagtatatagaactcatagttcacaacaagttaaggataactatgaggaattagaaggtaaagatgttacagttgctggtagaattatgtctaagagaggacaaggaaaagttgttttctcagatatacatgatagggacgggaagattcaattattcataaaaattgatgaagttggagaagaagcgttaaagcaatataagtctaatgatttaggagactgggttgcttgcactggagaagtatttaagactaaaacaggtgaaatatctgttaaagctaaaaaaatagaattaatatgtaaatcattaaagccacttccagaaaaatggcatggtttaaaggatccagatttaagatacagacaaagagaagtagatattataacaaatccagaagttaaatctacttttatgaagagaagtcaaattataaaaggaataagagaattcttagataatagaggattcttagaagttgaaacaccaatgcttgcaacaatagctggtggagcatctgctagacctttcataactcatcataatacattagatttagatatgttcttaagaatagctcctgagttatacttaaagagatgtattgttgctggttttgaaagagtttatgaattaggaagaacttttagaaatgaaggtatgtcaataagacataatcctgaatttactatgattgaattatatcaagcttttgcagattataatgatatgatggaattaactgaaaatatggttgctgaagtatgtaagaaggttaatggaacaacaaaggttacttatcaaggaactgaaatagactttatgccaccatggagaagaataactatggttgatgctgttaaagaatatgctggagttgattttgctgcaattaattctgatgaagaagctcaagctattgccaaagaaaagcatttagaattcccaaaaccattaaatactgtaactaagggtgaagtattaaatatgctatatgaagagttctgtgaagagcatatgatacaacctacgtttattatagattatccagtagagatttcacctcttacaaagaaaaagagaggaaatgaaatgttcactgaaagatttgaaggatttgtatttggtagagagttatgtaatgcatactctgaattaaatgacccaattgttcaaagagaaagatttgcgcaacaggaaaaagaaagagaacttggtgatgatgaggcttacatgatcgacgaagaattcatgagcgcattagaaacaggtatgccaccaacaggtggacttggaataggaatagatagattaataatgttcttaactgattcagcatcaataagagacgttatattattcccaacaatgaaaccaataaactaataaaatgataaaaaaccaccaaaaggtggttttttagttttaagctataaatgacaattttaagggtgagttaagtatatcataaatttaataaagtatatttttagaccgtattaaaggatttttatatttaacttattaaaactgtttaataagttaaatataaaattttaaagaaaaaataaaaaaatataaaaaaggtgttgcattttataaaaaagctgatataataaattatgcaatgacattccgcgatagctcaatggtggagcactcggctgttaaccgataggctggaggttcgagtcctcttcgcggagccattttaaatttcattgctgcaataatattccgcgatagctcaatggtggagcattcggctgttaaccgacaggttggaggttcgagtcctcttcgcggagccatttttattttaaagagttttgtaggagcagatgaagtctgttgatacaaaactcttttgttatataaagcaaaataatatataatttatcttgacatatataagctgtttgataaaattaatatataatttaataaacacgatgaaaaagaagagtaattttaatattttttttagagagatgatggttggtggaaatcattaaaaagttaaaatgaagggagcttttgagtgtagtttgtaaagttgggctttagccaagaagggtggaaccgcggaatttattttcgtccctttatggttataaggctttttttattataaaaaaataaatacgaataatttatttgtatatagcttatagaaataaagttatcgtaaaaaatggaggtagtaaaatggcagtagaaaagactatggataaaatagttgctttatgtaaaagtagagggtttatattcccaggatcagagatttacggagggcttgcaaactcatgggattacggtccattaggagttgaattcaaaaacaatgtaaaaaaagcttggtggaaaaaatttgttcaagaaagtccatataatgttggagtagattgtgcaatattaatgaatccagaagtttgggttgcatcaggacacgttggaggattttcagatccattaatggattgtaaagaatgtaaatcaagatttagagcagataaattagtagaagatcatatgactgaaagtggagtagaagttgcttgtgctgatggatggacaaatgaagagttaatggactacataactaagaacaacatagtttgtcctaagtgtgggaaaatgaattatactgatataagaaagtttaatttaatgtttaagactttccaaggaataactgaagattctgcaaatacagtatacttaagaccagaaactgcacaaggtatatttgtaaactttaaatcagttcaaagaacttcaagaaagaaggtcccatttggtatagctcaaataggtaaatctttcagaaatgaaattactccaggaaactttacttttagaacaagagaattcgaacaaatggaattagaatttttctgtaagccaggtactgatttagagtggtttggatattggaaagattactgctggaacttcttattaaacttaggagtaaactcagactctttaagaatgagagatcacggtgaagaagaattatcattctattcaaatgcaacatctgatatagaatacttattcccgtttggttggggagaactttggggaatagctgatagaacagactatgacttaaagaaacatgcagaacattcaggaactgatatgtcatatttagatccaacaactaatgagaaatatgtgccatattgtatagaaccatcactaggagctgatagagttgcattagcattcttagtagatgcttatgatgaagaagagttagaaggtggagatgtaagaacagttatgcatttacatccagctttagctccatacaaggcagctgtattaccattatctaagaagttatcagataaagctgatgaagtatactcaatgttagcaaagaaatttaatgttgaatatgatgaaactggaagtataggtaagagatatagaagacaagatgagataggaactcctttctgtattacagttgactttgaaactgaaaatgatggatgcgttactataagacatagagactctatgactcaagaaagagttgaaattagtaaattaacacactttattgcaaaaagcttagagttttaattaggaagcagcaagaaatgattattgaaagttatttcttgctgtttttgtttttagaaaaatgtttttaattttatatttatagaatgtgagaaagtataatgatataattatttgtatattggtaagaattattaataattataaattataaagtaatataatttagttggaggcagtaatgagagagtttaaggaatttaaagattttattaatggtaaaaatgttgctgttgtaggtattggtgtaagtaatattcctttaataaattttttgatgaaattaggagctaaagtaacggcttttgatatgaagaaagaaaatgaattaggaaaaatcgcaagtgaatttaaatcaaaaggtattaagttagagttaggtgaaggatatttagataaattaactggatttgaggtagtttttaaaacgccatcaatgagaattgattgtgaagctctagttagagcaaagaatgagggttcatatattacctctgaaatggaagagtttgttaagtactgtaaaggtaaaatatatggaataacaggatcggatggaaaaactacaacaacaactataatatctaagttgttagaagctcaaggttataaaacttgggttggtggaaatataggaacaccattgttttctaatatagaggaaataaactctgaggatatggttgttttagagttatcaagttttcagcttatgacaatggattctccaatagatgtatctattgttactaatttagcacctaatcatttagatatgcataaggatatgcaggaatatattgatgcaaagaaaaatatattcttatatcagaatgaagataatgtattagttttaaatagagaaaatgaaataacttatggatttgaaaaagaagctaaggggcatattagagaattttcatcacaaagagttattccaaatggttcatattataaagatggtacattatatttggaagggaaagaagtttgtaagaaaaatgatatagtaattaagggtatgcataatgtagaaaattatctagcagcatttatagctacaaaggatgatgttgaaatcaaaacaatgaaaaaggtagctgagacatttgctggtgtagaacatagatgtgaattagtgagagaaattgatggagtaaaatattacaatgattctatagcatcaagtcctactagaacgttagctggattatttgcgtttgaaagaaaagtaatacttatagctggtggatatgacaaacatataccttttgaaccattagctgagcaagggtatccttttataaaagaaataattcttatgggagatactaaatatttaataaaagaagcctttgataaattgaaattagagaaggggatagaagttcctagtattatggttaattctttagaagaagctgtaattaaagctaaggaaattgcaataagtggggatattataactttatcgccagcttgtgcatcttttgatatgttccctaattttgcggttagaggaaataggtttaaggaaatagtaaataagatttaataataatttatttttattgatatatataaagtgaaatatatataactacattgaatagagtatagaagtaaaagcaatagtttgagaaagttaagcacttttgttgcttttacaaaatgaatactttattaaatgtagttatttttttgaaattttaattataagaatattatattttaaaaattttcattataaaaataataggatatgagggttgataagcttaataaatatgaaagatgataaatatataaagcaaaatagcaacaacaaatcctggcgtatcaatataagaaaatattagtattatatagatataatgagaaaaataaatataaacatcgtaattaagcaaaaggatatagtttgtatattattaaacatgttaatataaaacacgtcgtcgggaacaaaacaagaaaagttcttgagacaaaagtctaacaacacaaacaaataaaacttcaaaaaagtttttaaaaaaaagtgttgacagacaaaaagaaaaatgatattatgattaagcagtcaggttgattgcaaatgatctttgaaaattgaacagaatataaattaagtaaccagcaattcttttgagagtcttaaaacaaagactcaaagtaaagcagctgacttgtaatcagcaggttgttggttcgactccgacatgaagctccaatatgggggagttcccgagaggccaaagggggcagactgtaaatctgttacgtttcgtttcgatggttcgaatccgtcctcccccaccatataagcatggtataaaccatgcttttttattttataaaaaaataaaaaataatcatattattttttatgaatatattaaatgttgacatagtataattatattgataaaatattctagaaataaaatttgatattagttcttatccagagaggtggagggataaaggccctgtgaaacccggcaacctattaacagttagaagttaacagttagaagttaagattaaagaaaaacattaagatttcatctatagctaaaaactaaaaaaactattaactagtttaatgtggtgcaaattcctgcagaacaattaagtttgcaagataagaaagaccttagataataatagtctcttctttttgcaagaggctttttttattgcttagaattaatatcaaaacgagaggagctaagcaaaatgagaagattatttacttcagaatcagttacagaagggcatccagataaaatatgtgatcaaatttcggatgcggtattagacagtatattagtaaaagacccaacagctagggttgcttgcgaaacagcagtaacaacaggaatggtactagtaatgggagaaatatcaacatcttgttatgtagatattcctaaggtagttagaaaaacaattagagaaattggatatgatagagctaaatatggatttgattgtgatacttgttcagtattaacatctattgatgagcagtctggagatattgcaatgggagttgatgaagctttagaatctagaattggaacaaaggatgatgttgaagcagtaggggctggagaccaaggaatgatgtttggttatgctactaatgaaacaccagaatttatgccttcaccaattgcaatggcacatagattatcaagaagattaactgaagttagaaaaaatggaactttaccttatttaaggccagatggaaaaactcaagtaacagttgaatatgatgataataaagttgtaagaattgatgcaatagttatttcgactcaacatgatgatcatgtaagtcaagaacaaataagagaagatttaatggaacatgtaattaaacatgttattccatcagagttattagatgaatcaactaaatattatattaatcctactggaagatttgttgttggtggaccacaaggtgatagtggattaacaggaagaaagattatagttgatacttatggaggatatggaagacacggtggtggtgctttctcaggaaaagatccaacaaaagttgatagatcagcagcttatgcagcaagatgggtagctaagaatttggttgcagctggtgttgcagataaattagaaattcaattagcttatgctataggtgttgcaaagccggtttctatagaagttgaaacttttggaacaggtaaattgagtgaacaagaaataacaagtattgtagaaaaagtatttgatttaagaccaggagctataataagagaccttgatttaagaagacctttatacagacaaacagcagcttatggtcactttggtagaaatgatttaaatttaccttgggaacaattaaataaagtagaagaaattaaaaaatacttataataaaaaagcgaagacgtcagtcttcgcctttttattaaattgaaaagaaatttactcagttagaaaattagtagtttatcctgaaactattacagagtttctaaataatatattttttaatttacctaggctgaattcattaataaactaataactaataactcaaaactaatgactagaataaactatttttcccttaactatagtcattttaatatcaatattatcgtcgaataaaactaaatcagcatcaaaattttctttgatttgtcctttcttatcatctattctacaatatttagctccgttaaaagaagccattttaactatttcatataaaggataatcagtattttcgtatatatttttgattgccttatttaaagttaaaattgaccctgctaatgcaccgttttcaagtcttgctgatccatctttaactacaactggttgtccgcctaaagaatagtttccatctggcattccacaagcgcacattgcatctgtaactagtaaagttttgtcagttcctttttgtttataagctattcttaatgatggatacgatatatggataccatcagaaattgtttcagtagtgatatcagtatcaaaagttgcccctacaacacctggttctctatgagtaaaacctgtcatggcattaaataaatgagttgaatgacagaatccacatttgataccttcgagtgcttcttcgtaagtggctttagtatggcctatagagcaacgaataccattttcagttaatatactggcaagttccttagcgccatcgacttctggagccattgtaattgatacaacagaatctattgcatctcccgtcatagcctcaaaattttcaaaagttggtttaattaaatagttaggattttgagctcctatagcattagggctaatgaagggcccttctaagtgtgcacctaatacttgagcaccatctgtaccttcaagtttagctttttttattgcagtcatagattttaatatgtcttctgatgacattgtcattgtagttggtgtaaatgaagttgtaccatatttacagatagttttagaaatttcatttattgattcaaatgtgccatccatagtatcatatcctccagcaccgtggatatgaacatctataaaaccaggcgctacatacaaacctttacaatcaataactgaatcataagaagtagtacttggatttatttccttgattatagcgttttcaattaatatagaaccttcctcaattctatctagaaaaataatattacagttttttaataacataataaataacctccctgtgatgtttaagctttttaccataagcaaataatttataagtgaataagaagagtataaattaacaatcaaaatttcacttatgatataattatataatattaataagtaaaataaaatgtttggagcgataatatggatatattagatggcttagttgaagcggtaatttttagaagtgaagatagtggatatgtagtagctaaaattacagcgaacaaagaggttgttacaattgttggaataatgccgttattaaaggaagggcaacaaatagaggttaagggaaattggattacacataagcaatttggaagacaatttaatgtagaagaatataaagagcttcttccaacatcagttaaagaaattgaaaaatatttaagcacaggcataatacatggaataggaccagtaacagcaaagaaaatagtaaaggcctttggagaagaaactttaaatatattagataataatattgaaagactcaaagaagttgaaggtattggtgataagaaatataacattatttatgattcgtatttggaaagtaaagaacttaaagatataattatgttttttcaaaaacatggagtaacaataaatcaatgcttaaaaatatataaaaaatttggaacagattctcaagatattgtatctaaaaatccatatattttaagtgatgaaatttcaggaattggttttttaacttcagatagaattgcaaaaagtctaggaattgagccagtatcagattttagaattcaaagtggaataagacatgttttaaataatttttcaggtttaggaaatacatatatgcctaaagataagcttataaaagagtgtcaaaaggtcttggttgtagataaagagttaatagaagcaaatatatataatagcgtattagagggtaaaataaaagtagaaaaaattaatgatgtagaagctgtgtatgctttgccatattatttttgtgaattaggagtaactaataaaattattactttaagtattgaaaattttcaaactataaattctgatatttcttttgagatatctagttttgaaaagaaaaataatatagaatttgcaggttctcaaaaagaagctatattaggggcttttgaaaatggtatagaaataattactggtgggccaggtactggtaagactactataattaaatgtataatagagatatatgaaaataatggaatgaaggttcttttagcagcgccaacaggaagagcagctaaaagaatgacagaatcaacaggaagagaagcaaaaaccatacatagattattagaaatgggcgtaagtgacgatgaaaattctttttttggaaaaggtgaaggagagccgctagaaggcgatgtaataattatagatgaagcatctatgattgacataatgcttatgaatagtttacttaaggccattaaacttggaacaagagttattatagttggagatgttgatcagcttccatcagtaggtccaggaaatgttttaagggatttaataaacagtgaatttattaaagttgtaaggcttaaggaaatatttaggcaaggcaaggaaagtatgattataaccaatgcacatagaataaataatggtgagttgccatacctaaacaaaaagggcggggatttcttttttgataatagagaaagtaatgaggaaattttagctactattttagatttagtaaatagaagattgcctctttttaatcctaagtgggataaaacgagggatattcaggttctttctcctactaggaaaggaatattaggagtagataacttaaacaatgagcttcaagctatattaaatccacctagtaaaaataaaaaagagagaaatcttaaggatataatttttagagaaggcgataaggtaatgcaaactaaaaataattattctttaaaatggaatagaacaggtggatatggcgataatgaaggtgtaggggtatttaatggtgatatggggtttattgaatctattagtgaagaaagtagaactgttactgttgtatttgatgatgaaagaagaattgtatacgataatatatatgtagaagagttagagttagcttatgcaattactatccataagagtcaaggtagtgaatttaaagttgtaatcacaccttcatttatgggttcagcttttttaatgaacagaaatattttatatacaggtataactagagcaaaagaattagttgtagttgtggggaatcaaaaatcactaaaatacatggtagataatacaaatagtatggagagatattcatcattaaaagaaagaattgtagatattgtatctgatgataaaataaaagaagaatagataatggagtctgatactatgaattataaggaattgagtaatgtttttaaaaaaataaataaatggtatagtaaaaaaacaaaggtgttatcaataaagacgaggccttttaatacagttgaaattttttcaaatatattaaataaagttgtgtgtaatgatagtaatatactatatgtattttgcagccaaaaagaaaaatgtgcatatgaaaaacaaagagagttatatggttatatcagtgataccatagaaacagaaaagattgaaaataagatcaaatgtatttttatagatgaaattaatgaaatagatagtttatatgatttagttgtatttgatgatataagtttattttcaaaagctagtaatcaatatataagggaagctatagaagatatatattggaattgtaataaaataatagtgtatgcagcagagtatattttccctattggggaaaagtttgaaattaattatatgcaatcagaaggacctatgatagagccgaggttaatgaatactaggataaaattagatcaggatattccactttctttatttgaatattttaagtggtttagagaaaataagagaattgttttaattatggttccttccgaagataaattaaataaagtttataatcattattatagtactttaaaagaattaaatataagagtagttcggtatagtaaaaatcaaaatttcagttttgttaaagaaataatagatggttatagtgatactttatttatagtaacaaataattgtggacagtatataagaaatattccagatgtaaatataataatgctatttgcagatgatatgttttattcttataagaagatattatatatgtgtgcagcaattaatgttaaaagtgatattcaatcagaagcaattatggtatctagggaattttctgaagaaatggataaggctaaaaatatagcgagattatttaataagaatttatgggaaagacaatatttaaaatattaaaaataatatataagcaattattagatatagtttatccgatggaagaaaaatgtatcatttgcgaaatagaaggatttataggaatatgtgattgttgtaaaactgaaattaagagatgttatatggaagacaaaaaaagtatttcgtatggattttatgggggagtattaaaaaagttaattttagagttaaaatataataagaattttaccgcagcagagatattatcaaatttaattttagagataataaataatcaaaatattaaggctgatgtaatctgttatgttcctatgactaaaaaagcaattaaaaaaagaggatttaatcaatgtgaagttatatcaaagagtattagttacacaacaggaattccaattagtaattgcataataaaatcaaagaatacaaaggaacaaaagactttgagtaaagatgaaagaaagagtaatattcaaggtgcctttaatataaaaagaaattacgacataaaaaataagcatgtaatattgatagatgatgttattactactggagctacattagatgaatgtaaaaaaattttattaaaatatggagcaaatgaaattacagtattgacaattgctaaaagcaatatataatagtaatataaagttaggtctgtggatgaaagtcgatgccagtcgcaggcgaaacgatccacgtaagttaggcaaagttttaatgagcatggtgcggtatagaagtaagtcctgccagtagagatactgagagtgttagtagtgagaggttaattccgggtagcaaaagctccagcaggcgagtgtgggggcaaaatccaggtcagctaactttataaaaaaacatcaattcatatgaattgatgtttttttattttattaaattttaagaaaaataaaggaaaagagagttatgtagagttaacaagtttaaattttctgtaaattcagataataatacttgtggaataaatttgaaaatgataatatataaatatactaaatataaatattgaaatcttaataattataattagaacttaaagagaggggttgaccttatgagagtaacagtaataggaaagaacattaacgtaacacctgcattgaaagaaatagtagaaaagaagatttcaaagttagacagatactttgaaccagaagtaactgctagagctacattaacagttcaaaagaataggcaaatttttgaggtaacaataccttttaatggagtaattttaagatgtgaagaatctacagatgacatgtataaatctatagatttagtggaaagtaagcttgaaagacaaattagaaagcaaagaacgaaattacaaagaagaaataatgaatctttaagatttagtaactttgatgaggttgcatctgaagaagatgataatgaaggggaaatagtaaaagttaagagatttaatataaagccaatgagtactgaagaggctatattacaaatggagcttgttgaacataatttctttgtatttaaagattgtgatacagaaaatattaatgttatatataagagaaaagatggaaactatggtttattagagcctgattatgtttaagatataatatataataaataaggagagctatattaaggctctccttatttattatataaatgctaaatttaagtgaaagttttaagctacatacatttatgttgaattataaagagtataaatggtataatttattaagtaaaatattagaagggtaattttatataaatttaataattatataaaaaaattttaaatccattacttaattttatattcattttttatgaatattaatattgaaaggaaatacattatgggatttttagaaaaagtttttggaacatatagtgagagagaagttaagaaacttcaatcaattgcagataaaatagagtctttagatgaggcaatgcaaaagctgtctgatgaagagttgcaagctaaaactgttgagtttaaagagagaatacaaaaaggtgaatctttagatagtttattaccagaagcatttgctgtttgtagagaagcatcaagtagagtgcttggaatgaagcattttagagtgcaattacttggaggtatggttttacatcaaggaagaattgctgaaatgaagactggggaaggtaaaacattagttgcaactttaccagcatatttaaacggcttaactggtaagggtgttcatgttataacagtaaatgattatttagcaaaaactcaaatggaagaaatgggagtgctttataatttcttaggattaacaactggatgtataattcacggaattacaccagagcaaagaagagctgcttatgcatgtgatattacttatggaacaaataatgaattcggatttgattacttaagagataatatggtaatacatatggaagacagagttcaaagagaacttaacttctgtatagtggatgaagttgactctattttaatagatgaggctagaactcctcttatcatttcaggaatgggagataagtctactaagttctataatgttgctgataattttgttaaaacattagtaaatgagaaggattttaatgttgatgaaaaagctaatgctgttttattaactgatgatggtatagttaaagcagaaaaatattttggaatagaaaactatgctgattctcaaaacctagaattacaacattatgttactcaggctttaaaggctaactatactatgaaggccgataaagactatatggtaaaagataatgaagtagtaataatagatgaatttacaggaagacttatggaaggtagaagatattcagatggtcttcatcaagcaattgaagctaaagaaaatgttaaaattcaaagagagtcaaagactttagcaacaattacattccaaaactatttcagaatgtatgctaaattatcaggaatgactggtactgcattaactgaagaaaatgaatttagggaaatatataatcttgatgttatagtaataccaactaataaaccagttcaaagaattgaccaatcagatatggtttataaaaatcaatctggtaagtataaagctatagttgaagaaatagtaaaatcacatgaaaagggtcaaccggtgcttgttggtacagcaagtgtggatagatctgaatatatttcttctttattaaagaagagaggaatcaagcatcaagtgcttaatgctaaatatcatgctcaagaagctgaaataatttctcatgcaggggaattaggaatggttactatagctactaatatggctggtagaggtactgatattaagcttggtgagggcgttatagaagcaggtggattaaaggttcttggtactgaaagacatgaatcaagaagaatagataatcagcttagaggtagatcaggacgtcaaggtgatccaggtgaatctatattcttcatttcattagaagatgatttaatgagaatatttggttcagaaaagattcaaggaattattgataagttaggtcttgaagaaactgaagctatagaaagtaaaatggttactaaggctatagaaaatgctcaaaagaaagttgaaggaaataactttgacataagaaagaaccttcttggatatgatgatgttatgaatcttcaaagagaagttatttatagacaaagaacggaagttttagaaggtaaaaacttaaaagagcaaatagaaggaatgattgaagaagttatatctgatgctgttaattcacatttaagtggagaggttcaagatatagaagctgaaatcaaaacattagttcaatatttagaagaaatttgtttaccacatggtgttgtaactgtagaagaattgggagatttatctaatgaacaaatgaaagataagttaaccgaattagttatgaatatctataaggggaaagaacttgaatttggtgaagaacaattaagagaaattgaaagagtagttcttttaagagttgttgatcaaaaatggatggctcatatagataacatggatcatttaaaacaaggaatgggattaagagcatataagcaacaagatccaattcaagcataccaaatggaaggtagtgcaatgtttgaagaaatgattgagggaattaagcttgaaacagttaaattcttattccatgtaagagttgaaagacctgttgaaagagaaaaggttgcagaagaaacttcagcaagtcatggagaagatgataagagcttaaagaaagagcctgtaagaaatgataataaggttggaagaaacgatttatgcccttgtggtagtggaaaaaaatataagaattgttgcggaagagaagcataatagaaaaagtgcctaaagggcacttttttcatcagttagtggttactagttaaggataaaactcaataaggagtttctttaatatatatttttataaattcggcctaggttgaatttattcaatagactactaactcataactaaaaactcataactaattcaaaggggtgatttttgtgttaataaagttagaacaggaactgtcaaaggttagtggcttaaaagaaacattaaaagaaatgggggcttcactttgacaaggaaagtctagaaaaaagattccaagaacttgaacttcaaatgcaagaaaaaggtttttgggatgatgttaagagggcagaagaggttactaaggagagtaaaggaattaaggatagaatagataggtatgaaagcttagtaagcagattagatgatgttgaaatattagcggagctagcagaggatgatgaagaaacgattaatgaagttatttatgaaatcagagatatcgaaaagctagttgaagaatataaaatagagcttctattatctggggaatatgataaaaatgatgctatattaaatttacatgcaggtgttggtggaagtgatgctaatgattggacgcttatgcttcttagaatgtatacaagatggtgtgagaaaaaaggctataaagttgaaactttagatttacttgaaggtgatgaagctggaataaagagcgcaacattgagagtaaaaggtgaatttgcatatggatatcttaaggctgaaaaaggagttcatagactagtaagaatttcaccgtttaatgcaaatggtaaaaggcaaacatcatttgcatcaattgaagtattgcctgagcttacaaaagatcaagatatagatataagacaagaagatttaaaagtagatacatttagagctagtggagcgggtgggcaacatgtcaataagacggaatctgcaattagaattactcatattcctactggtatcgtagttcaatgtcaaaatgaaagaagtcaattttcaaatagggatacagcaatgtctatgcttaaatctaagcttatagagcttaaagaaagagcacataaagaaaaaatagaagatttaacaggtgaacttaaagatatgggatggggaagtcaaataagatcatatgtattccatccatataatatggttaaagatcataggactaatgaagaaactgcgaatgttaatgcagttatgaatggagaaattgatcaatttattactacttatttaaaaagtatatcaagataataaaaataacagctaataaaattagctgttatttttattatcttcattttgagttgaattttattaaggtaataaatattattgaaaaaccaaatatcaatgcaataattaatgcgttggtatagcctttaatataaaatacggtagcagttatcactgcaattaagcctattactgtaaaaagcattgagctgcttttatcaagtaaaaacctattcttagaaaagataccccatataattaataatatcaaaactatagatataaaaataatggaattttgactataaataaatcttgttaagctgctgtaacaagaggattttagttcagtttcaactattttataaactgtatctatagaatttgtatctatataatctatagtatcgtcgggggtgtgaattcgtgttttatcactatgacagaagcttaaagcatcaatatttaagttattaaagcttgcatgatcacttgaatcttcatatagaacttcataatctactgaattatttttacatatagattttatagattcaagcaattcagaatctgtatttttaaatttacttccttgcatcaagcttataggataatcggcactaccaatcatatcaaaatttattacttttgagtcttgaatattaaataaattttcttcagcaaaggctttagaacctaaaagaccaaattcttctgcatttaaggcaacaaagataatatctctctcaggtcttccataggttgaaagacttctactcaattctaatataaatgaagtgccagaagcattgtctaaggcaccagagtaactagttcctaatccatccttaccaagatggtcataatgagctgtaactataaatggtgaaagggaggaattagaacctttaattacaccaataacattagagattgttttttcttcttcttcaaatggaatatgaactgaaatttcttttccttcatttaagctagcagttatcttatcaaaagcattttgtgaaaccataatgacagcatcttttgcaaaatcactgaaaaatgagcttctaaatgaaaaattattatcttttggaacatataataaaaatgttccgtcattacatgttatatcaagataagataaataagagtttattttatcagactttgaaaatgaaaaagtattgtttttaaagttaatcatatcctctttaaagtcaataccatattgcagttcttcttcagtatctccattagattcaattttcaagtatggagaagtatttgtaattacaggacaaacggtattaaaatcttgagtataattaccatcgtcatttaatgtttttaatccataatcaataaatctattttttattatttctgcagcaactgtattttcagtgctaccagctagtctacctcctaacgtatctgatgataagacatatatattattacgaacattagttgagtcaaattgcgaatatgtattattaagatagagtgtagttaagagaaaaaaagatattattgataaaaacaaaaagtataaaatttttttcttcataaaaagatacctcacaaatattactatacttaataatattattagagattttacattataactgaaatttcaaaattaactgagattccaaattttaatttggcaaatcgaagttactcatccaatgtaaggaggaacagttttttgacattacaaacatttatatcagtaatttattataatttaatacaaattaatagatagttattttatggggaaatatctataaagaatttatatttaatttaagctttattttgaataagttcaaataaacattggaataaagaaaacaaaatacatatatatacaaatatgttgatctgatcttttaatacgtaaaaaacaccacctattataactgaaactagtataacaccactaataaattttaaaaaattggatttgccagttaatagttgtgttgtagcagtgaataatataattattagagttaaaaaaataaatacatttcgtagatttgttgaaaagtcaattacataaaattgatttaatgctaaaagtgtaataaaaactataagacagatgtttaaaaagccgtacaaaaatttattcaaaataaattcacctcgcatgaaaatggtaatattttacaaattaaattatactattctattaacataatagcaatagtgtaaaattatgttatactaattaatagagttatttgtgtaaataatataatttataggaggcacttatggtaaatatagaagaaagattagttagagaattaggaataactttaaaacaagttgaaaatgtaattaaattattagatgaaggaaatacagttccttttatctctagatatagaaaagaacaaactggtggattaagtgatgatgtattaagaaaattcttcgaaagattgacatatttgagaaatttaaaagaaagaaaagaagatgttttaagattaatagatgaacaagggaaacttaatgatgatatagttaatgctttagaaaaagcggatacattaacagaagttgaagatatttatagaccgtataagcaaaaaaagagaactagagcaacaatagcactagaaaagggattaaagccattagcggatttaattttagaaggcaattttaatggaaatataaatgaagaagcaagtaaatatatagatgaagaaaagaaggttcttacagcagaagaagctataagtggagcattagatatagttgcagaagtaatttcagatgaagctgcttttagaaagtggataagagagcttgtaatgagagaaggaaaaattgagtcaaaaggttcaagtgaagaaccaacaccttttgaaatgtactatgaatatagtgaagatgtaagcaagattcctgctcatcgaatattggctataaatagaggtgaaaaagaaaaggttctatctgttaagatagtagcaaatgaagaaaaaataataacttatcttcaaaatagactaataaaaaataatgaagtaactgataagtatttaaaattagcaataaaagattcatttaagagattgatttatccatcaatagaaagagaaattagaagtgaattaactgataaaggtgaagagggagctatattaatatttaaggaaaatttaaagtcattacttatgcaagcacctattaagggaaaagtagttatggggtatgacccaggatttagaacaggttgtaaggttgcagtattagatccaacagggaagtttttagaaaaggctactgtgtatccaaccgttcctaagaaggacatagaaggaactaaaaagctattaaaggaacttatatataagcataatgttgatgttatttctttaggaaatggtacggcatcaagagaatcagaagaagtaatatctgaaatgttaactgaaattaagaatgaaagtggaaaagagttagcttatgttattgtttcagaagcaggagcatcagtttattcagcatctgagcttgcagctaaggaatatccagatttagatgtaactataagaggagctatttctataggaagaagacttcaagatcctatggcagaacttgttaaaattgatccaaaggctattggggttggtcaatatcaacatgatgttacacctaagagattagatgagtcattaacaggtgtagttgaagatagtgttaataaggtaggcgttgatttaaatactgcaacaccatctcttttaacttatattgcaggaattaatgcttctatagctaataatatagttgcatatagagatgaaactggtggatttaaaacgagaaaagaattgttaaaggtaaagagattaggtcaaaaagcatatgaacaatgtgcaggattcttaagagttatggaaagtaaaaatccgttagacaatacagcagttcatccggaatcatatgaagctgctgaaaagttaataaatattttaggttattctaaagctgatttaaagaataaaaatttaagtgatattgaagatagagtaaaggaaaaaggtctaaaaaatttagaaatagaactagaaattggtgaattaacattaaaagacataattaaagaattacaaaagccaggtagagatccaagagaagatatgccaaaaccaattttaaaaactggagttatagatttaaaagatcttaaaccgggaatggagcttatgggtacagtaagaaatgtatcagactttggagcttttgttgatatcggggttcaccaagatggattagttcataagagtcaaatggctaatagatttgttaagcatccacttgatatagttaaggttggagatgtaatcaaagttaagattatggaagttgatgagaagagaaagagaatttcattaactatgaaggatttaagccgataatattattgcaaaatgaaaaaattagtaatataataaaaacaaataaataataaatatcttcagggcagggtgcaagtccctaccggcggtatagcccgcgagcaatttttgcagattcggtgtaactccgaagccgacagtaaagtctggatgaaagaaggtaaatagtgatttgagtaataacaattttttttgttatatttaattattgttttgtttttaatgccctggtgtaattttacatcagggctttttgaattaaataattaaatattggacaaactgaaataacaattatttgaataagctattgccccgaaggatatcttttgggaggagaaaatatatgaattcatcaaaaaatttaaacaaaatggttaaaatttctttattatctgcaattgctgtagtattaatgtatttcgattttccaataatacctgcatttccatggcttaaaatcgatttgagtgaagtacctgcattaatgggtggatttgcttatggaccagtagctggtggagtgatagttatattaaaggtatttttaagatttttgataaaaggaacagaaacaggctttgtaggagaagtagccaatattataattggccttgcattagttattccagcagcttggttatatactaggaagagaagtaaaaagagtgccatagtaggaatggttataggtgccttagttatgcaagttttaggaatagttgcaaatgtatttttcttattacctgcatatggtatgaatttagaaggggctgctttaataaattatatattattaggattactaccttttaatgggttaaaggcgttaatagtatgtatagcaacatatttattgtataaaagagtatctcgtgcgatctttaaagttgatagtaaatttgaaagtaataaaaaagaaattgcataaaataaaaagagggtagcattgctatcctcttttccacattataagggcatcttcaccattatcggaataatagccttttcttaaaccttcttctttaaacccaaatttcttataaaggttttgagcagggacatttgaagatctaacttctaaagtaatatcattacaatcaaaagttttgcacacctcaaataattttattaacaaatttgatgcaatgccttgtttcctatattttgagcttacggcaatatttgtaatgtcgccttcgccagcaattatccatacaccgacaaatccaattacgtcacctgtggatgaatcttgtgcaattacatattttgctagtgaattatttaattcattattaatagaatctaaagtccatggagtagcaaagcattctttacttaactcatatacaccatttatatgagtttcattcataagactataatctattttcatttttcatagccagcctttgctcaagttctctttctgcttgaggtttcttaatataaagtggagcagaattcatatcgtcaatatctccaactttaattttttccattccaagctcacctaaagatgaagcccttatgatacttaaatgatttggagcaaattcgcaattgttaatattattgcttaagaattccttgtgtttaaatactccatcgccagtaaatataactttttcacctttttcatttaatatattagcaagttcacttaagtctaaagctgtacagtctaatatttttgttagctttccttctatattcttataaagtccagtataaacattatcccttaacgcatccattactggacaaattataccatcaaaagttaataaagaattagctaatgcatctaaactggaaatagaaacgtatggtttattagatcccatacttaaacctttaatagtagccattccaattctaagtcctgtaaatgaaccaggtcccttagaaacaacaaatccatcgacttcatttatatcaacttcacagtcttttaataacatttctattttttccattaatataatagaatgttctcttttgaagtttaatgtatattcacctaagatatactcatccttaagtaaagctacagtagtcactaaagatgaagaatctatacttaaaactatcatatttttagctcctttatataatcatatctttctccatatggagttatagtaattgttctataatcttcgcccttttctaaatccttttctatataaatatgtagaaaatcttttggaagtatttcctcaatataattagcccattcaataattgaaacggcatctgaaaaaatgtaatcatcaaatccaattgcatatatttcatcaggatctgaaactctataaacatcaaaatgattcaactttaaacgaccagaatcatattcatttacaattgtaaatgttgggcttgttatgtaatcagttatttctaagcctttcgcaattccttttgttatatgggtcttaccagtacctaaatcccccgttaaacaaactatatcaccggcttttaatattttaccaagtgatataccaaggtttgtagtctcttcaacactattaacagaaaaaaccatgttaaaatcctcccttttgattagttaggagttagtagtgattagttaggagttaaattaatcttttatatataattaataaactaaattagcaactttaacattaatttttatctctaaacttttaactattaactcttaatagtatttgctattttatattttatccaaaaagtacgaaaaagaaaagaattatagaaaaatagtagaaaaaatattgattttattaataacataatgtataataactttgtactaaggggtatcgtatatcggtagtacagtagtctccaaaactattaggctaggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggtatcgtatatcggtagtacagtagtctccaaaactattaggctaggttcgattcctagtacccctgccatagaagctagtaagattttcttgctagctttttttattttttataaaaaaagataaaataaatttgtgatactacacaaagtgaacaaatgtttgaataaatttattagtaatgttaataattaagaggaaaaatatctttgattagtaaggagaatttatgaatagagcactagatatattaaaacaatattatgggtatgcttcatttagggaaggtcaagaaaatataataagagaaatactaaatggtaatgatgttttaactatcatgccaacaggtggaggtaaatctatttgttatcaagtacctgcgatgttgttagatggtataacaatagtgatttctccattaatatctcttatgaaagatcaagttgataatataaataatttagggattaagtcagcatatattaactcttcattaaacaataatgaaataaataatattttagatgaagctgcaaaaaatgaaataaaaatactatatgtcgcaccagaaagattagaatcacagtcatttttagagcttatagctagtattaatgtttctatgatagctgtagatgaagcacattgtgtatcacaatggggacatgattttagaggtagttataggagaattagtagagtagtttcacttttaagaaacagacctatagttgcagcattcacagcaacagccactgctgaggttagagatgacataatcaaattattagaattaaataatccaaaggtatttatgtctggttttgatagaaaaaatcttaagataataatagagaaaggtgtaaataagaaaaattacattttagactatataaatagtaataaagatgaatcaggtataatttattgctctactagaaaagaagttgatagcctatatgatttattaagttctaaaggattagaagtggaaaagtatcatgctggattaaatgatgaatatagaaaagaagctcaagaaagctttatttatgataaggtaaatgtaataattgcaacaaatgcatttggtatgggaattgataaacctaatgttagatatgtaatacattataatatgcctaaaaatattgaaggttattatcaagaaataggtagagcaggaagagatggtgaggatagtgagtgtataatgttattttcacctggcgatgttcaaactcaaaaatatattattgaaacagcaacggaaagtactgtaagaaaagaaaatgaacttgaaaagttgcaaacaatgataaatcttgtttatacacaagattgctatagaaaatatatattaaattattttggtgaagggtacgatgaaaagtgtaataactgtagtaattgtgagaccccaggagagttagttgataaaagtatagatgctcagaaagtaatatcttgcgtttatagaatggaacaacgttttggtattggtatggttgtagatgttctaaggggttctaaaaataagaaggtatatgaattgggatttgatgaattatctacttatggaatagtaaaaaattatacaaaggatgcattaacggaatttataaatatgttaatttcacatgggtatttaaattataaaggagaatatcctgttttgaaattaaatcaattatctatggatatagtaaaaggtgaaaagcaagtatttgttaaggaacaagtaattaagaagattaaagttgaagaaaatgaattatttacgatattaaaagaattaagaatggagatttcaagagaagaaaaaatacctccttatatggtatttggagattcgactttaaaggaattgagtaataggatgccaataactgatgaacagttcttagatataagtggagtaggtaattcgaagctaaataaatatggtgctacatttattactaagattaaagaatatattgaagaaaaaaatatagaagttaattggagatttagaaaggctaagagcgctaatatatcgtttgatgaagttttagataatgatgacaataaaaaatctagtaaagtcaaagaagatggagaaaaaagaaaatcttatgacattacagttgactatattaagttaggaaaaacattaaaagaaattgctaaagaaagaagtttagcattggtgacaataatgggacatatacagcaatatatttccgaaggaaatgaagttgacttcaagataaattttgatgaaattttcgataatgaggaagaaaaaataatattaaatgcaatagatgaagtaggatataataaattaaaagatataaaagaaatagtaccatcagaaataacatatgatgcaataagagcagtagtattaaaaaaggtaattagcgaagttgctaactaaattgttcattatagtaaagcacaaaaataaagctgatgctatttgcaacatagataattaactaatttaaattagattaggtttagtgattttcagctggtaataaataaaaaataaatggagtatcggaagggaagttacaataaattaagcgaaaagcccacttccttaggtgtgggatggataatattttcagttgacaataattataaggtcatggtaaaatagtcaatgttgaaggggtatcgtatatcggtagtacagtagtctccaaaactattaggctaggttcgattcctagtacccctgccaaacttaaaaaagacttagcataaaatgctaagtctttttacgtattatacaagtattagacttaattcatttaattgacaagtaaatatttaaagtgttagaatactaatgtaatatgcctaaattgggagcaatcttagtttaggctatttttttagtaccataaggggagttttataaatgatagttgaaaaagttttaaataataatgttgttgtttcaattgatcctaagactaaaaaagaagtaatacttatgggcagtggaatagcatttaataaaaagccggggcaacaaatagatgaaaagaaaattgaaaagacatttatagtggatgatgaaaatctaggaaataaaattaaaaagttaatcaatcaaattccggatggaatatttgaacttactgatgaaataattacttatgctattgtagagcttaatacagtattagataagcaaatttatatttcgctagcagatcatattgcatttgctgtaaaaaggtttagaagtggaattataataaaaaatgagttgttaagcgaaataagaagagtgcatagggcggaatttaaggtttcgttatgggcagttgattatataaatgaaaaattaggggtcgaattgccagaagatgaagctggatttattgcactacattttgtaaatgcaggatatagagagacaacaatgaaatctataacttcaactaaaattattaaagatatattaaatataattaaatataattttgcaatagaattagatgaggatgagttaaattatgatagattattaactcacttaaagtattttgcaaaacgtattgtgaataataatcaaaataatagtaccgattccgattttattaagatgatttcaacaacatatccagaagcatatgaatgtgcagttaagataggtgattatatattgaaaaataataattattatgtaaatgacgatgagatagtttacttaactatgcatattcaaagagttattactgtagcacgtgaaaataatgttaaatagaaagagaagtacaaaaatttaatattaataaataagaattttgaatagcggtaagtttcaagttaagaaagaagttaatctaaattttaatttaggtagatatatttttgaaaaattataagaaattcatccttaacttgttacttactacttaaaaaagaaaattttaagattgtttaatccattcagagtaaggtgttgaataattttcggatttatttttttcaacataattatagaagtcttttaagaattctaattgagtagagttatcatgaagattaattccaccaatattatattgataagttaataattggtctaatgataaattactagtatttttaagtgcttgatacataaccatgaatgaagtggttcttccttcgccagcatcgcaatggaagtgaaggtgtaaatcatcaggtttattctttatgaattctacaaattcgtcgacaatagtaggtgttggtgcaccattatcttttacggcaaatcttttatattgcattcctgaatctgtaactacagtagattcattactaacaaaatcagcagttaaattttgaataggagcaccggtacgtctatagagtgggactgtgctaccgattttaattttgtttaataaagagttctctgtgttaatagtttcttccgttgtaaagccattatttaagtccttatatctatcaaaaaaacttatagcaaattcgtttaccattccatgtgattcttgtcttaaatctacaatgcatatattttcttttgcaatagaatcctttaagttttttgcttgttctttagtaaattgagcgcttccagaaatgtttaaagtaggaatatctctaaatctatcaggtagaccaacattagagctaccatcacgaacaattaatacttcattctttttagaagaaattagtgggatagcagaaactagtgaactacatataaaaaataaactgatacagattagtaatttaaaagaaaaatttttcataattaacctccaataattaaatttaataatattttttgtaaatcaacaaaatttattctgaactgatggaaacataatttatactataattaagaaagtaaatttttattttattaatttaaaaatatatttatatggaagtataataaaaatattattatgtaataaataggagaatggaaaatgagtgaaggatatgaagaacgtaaatacccagaaaaatcttggtcaatttcgagaatgaagacattagattcttgtcaaagagaatattattatacgtactatggaagtcataatggatggatttttaatagtacagatgaacaaaaaatagcttggagattgaaaaagttaactaatttgtggatgtgctttggagaggttgttcataagcagattagaggaataattaacatatgtaaaaaagataaaagtaagtttatgaatgcaaatagatttaatgaaattacgttaaatgagctaaggggaattattagagagagtattaataaatataatacaaaggaatgggatgagtatcctagaggtaatatgcttcaagaatattattatggtgggaaaatatctaatgaaacaggagaagaattaaaagaaagattaattcaatgcgttaatagtttttatgtttccaaaacctttgaagatatattgaatgaggaaactataattatagaaaatgatgaagatatatttaatagttttaattatgaaggcttaaaggtttattctaaaatagacttattatataaaagctttgatggttattatgtaattgtagattggaaaacaggaaaagtttctaaagatgataaggaacaattgcttgtttatgcatggtatgtaattcaaaaatatgatgttcattattcaaaaattaaggggagaattgaatatttattagatggtaatgtagaggaaatcatatttaaatgtgaagatattgaatatataaaagcaaaagttgataaagatttaaaaattataaattattatttagatgatattagtttaaataaacctaaagaaaaaagtgtttttgaaaaaacagaaaaaagttataaatgtagtcagtgtaagtttaggcttatatgtaaaaatgataatgattaaaatattgtaatttggatagaacttaagataaattattttaatatgaggtgaatcaatgagctttattcaaatacaaggagtaatattttttagtataataatttgttcactaataggtggaaagaaagcttcgttaatggcaagcttggtatgggtaattgaaacatttatagtatataaaacgagtaaagttaattatcttcaagttatttctgtgtctttatcatttcaaataggaatggtcttagcaattgcaagagattttatagttaagagactgaagaagattactaataaggaaaacagttgagataaatccaaattaataaattataggtattatttacttgtaatataaaaattcatagtggttaatataatagtgtaaacaagatatgacttaaataaatttaagttatgtttacaaaataccggaagccaaaggaggaattcattatgtcaaaagcattagttccagaagcaaaacaaggattaagcgcattcaaaaatgaagttgcagcggaaatgggtgtaccattcactgattacaatggtgatttaacttcaagacaatgtggttccgttggtggtgaaatggttaagagaatggtagaacaatacgaaagtggattaaagtagaaaaccactaacgggtacaaaactaacgaattagaggaaacaatacttcgagagggtgagtactgttatgggtgaaataccaccagaaaattaaactatcattcaaaaaagagaagagttacattagagtaggagttctacaataatgtagctcttttcttatgcccataaaaatggtaaaatatgaacaaaagttcgcaaagtaggtgatagtatgaaacaagttaaaattttacattgtgctgatttgcattttgatacaccttttaaggagcttacaaaagaagtttcagaaaatagtaaagaagaactgttagaagtatttaaaaatataatagatttaaccgtaaaagaaaatgtagaggtattacttattgcaggggatgtttttgataatttaacagttaataagaataccttattttttatagcaaatgaattaaagaaaatagaaaatgtaaaagtatttatttcaccaggaaatcatgatccttataacgaaaagtcattttataagatgattaattggcccgataatgtttatatatttaaaggagaacttgaatataaagaagttagtgagctgaatctagtagtttggggcgctggatttaatgctaattatgagcatgaaagcttattaaaagaaattaatgtagatagaagtaagataaatattatggttattcatggtgaagtggaaaagggaaatgcgaaaaatgaatataatccaatttatctaaatgaaataggaaaatcaggtttagattatattgcaataggacatagacataaattttcgggaattcttaaagaaggaaacacttattatgcatatagtggttgccctcaaggacggggatttgatgaagaaggagaaaagggagtaattattggagatgtatactgtggaggagtatcactttattttaaacctatttgtaaaagaaaatatataactcaagaaatagatattagtgatattaatacttatgatgaattaatatcaaagatattgtctcaggtaaatgatgataatttcaagcaaaatttttataagataattttaaaaggggagataaaagagcatttttatttaaatgaaagaatattaagtgaaaaaataaagagagaattttactatataaagattattaatactacgagtattgcagtagatttagatcaggtaagtcaggattattctgtaaagggtaagtttgtagctaaaataatgaagaagatagaagaagcaagtggtgatgatgaaaaagagttattaaggcttgcattaaaattaggaattcaatgtctttcagaagaagaggtgaatttaaatgattattagaaatgtgaatataattgcttttggtggaattaaaaataaaaaaataaattttaataaaggattaaacataatatatggagaaaatgaagctggtaaaagcactattcaagcatttataaaagtttggttgtatggtttttcttcttataaaggtaaagattataagttaaatgaaagaattaaatatacacctaatagtggtgaagctataagtggggaacttagtatattacatgaaaataaggaatatataatacgaagaaaattcggaagaactaaaaaagaggatgtttcaattattatagatgctattactggtgaagaaataagttttattaataaagatgaaccaggaagatatttttttaatataaatagagccacatttgtaaatacattatttattggacaattaggtgtaggagttaaaagggataaagaagaagagatattagacaaactatcaaattcaataggaactgaagaaggacaagtatctgtagatgtagcatttaataagctagataaatataaaaaatctatatcaaatgtaagaaaaaatggaaagcttgattgtttaagaaacaaatatagtgatttgcttagtgaaagatatgaagcttataaattatcaaatcataatatagataatgaagaaaaattaattcaattaaatgaagaaaagaaaaatttaaataaagaagttgctaatttggaaatatataaaaaatacttaaaaaagataaaaataaaagaagagtatcaagaaatagcagagtattttaagaagaaagaagatctaaaaaataaagaagtatcaataagtaaatcattaaaatttaaagatgaaataataaattataatttcatagaaaatcttaaagaagaatatactatgtatttaaacttattagatataactaaagaagaagaagaaagaatttctattaaagaagagaaattaatggatttaaaaactccattacgtaattattattatatggagaacttacctgaaaatatattaagtaatttagaagcattaaaaataaaaaatgaattattaaatgaaaaggttgaaataaataattcgatagaaagtgaaattgaatttttaaaggttaaggaaaaagaagcacaaaaactaataggttcagcaatagaaattaaaaattttaagggtgatatagaggaactatttgtaagatatgaagataagttgaaaagtttaaaattcataatggaaaataaaagtgaagttactgtacaaaatacaatgtttttaattttattaggaatagtatcattaataagcattaccttaggtatatcccttaataattctattaagtttatattttatataattggcatagttatattattttttttaggtgctaatatatatactagtaaattaggattaggaaaaaacaaaacaacatatcaattaaatgaaagtattagaaaaattgaaatagaattagataaatattgtgataaattaaatgttaataactatacagaattattaaaaaaattaaaagtttatgatgattatttaagcttacaagaaaagattaatagtaagatgaatgaaaaattagcgcaaaggaaattattatcattagataaggctttacgtgaccatgaggaagttaataatgagatagaagagtacttaaaggtttcatcattaagtagtttagaaaaattaattgctgagatttataaatataaagagttagctaaaggatttactaatttagaaattgaaataaataatttaaaaagaaatttaaatagaactaaagaacaattattaatcagagaagaaaagttaaataaaagtttgagttctataggatttaataatgtgaatttagttgatgttgatgaaattattaaagaactagaggataagctaagaaaaagagatgaaataaataaaagcctcacatccgttgaagaagcatattcagcattaactagaggaaaagatattgaagcaataaaggaagagttaagtgatgtaataaatataaatactaattattcttacgaaaatgaagatgaaatagatgatgctattagagaaaaaaatataagacttgttgaagttgaaaagaaaataaaagatatagaaaatgaaataaaaaatagatttaatggtaagagagatattccaactattgaagaggaaatcaaagcggttgaaagttatatagaagagtctgaaaagtatcttaaggctagtaatattaccgatgaaatattaaatgaagtttataatgagataagaggaagttttgggccgattcttaataaaaatgttatttcttcttttaaagagttaactaataataaatacaaggatgttatggtatcagacacttatgagatgaaagtaaaagatgctaataatatattatcagcagatatactaagcaatggagcaaatgatcaattatatttatctttaaggttagcttttatagaaatgatatttaaaaataaaaaaattcctatatatttagatgatgcatttgttcaatatgatgatatacgtatggaaaagacaattaagtatttaataaggggaaattttgagcagtatattttgttcacttgtcaaagaagagaagaaaatgtagttagaaaaaatagcattgaacataaatatattaagttataagtggtaatcaataaattattatggattaaatgggaaaaatagtctaaactattgattatagaattattttaagaggtatcaagaatggaaaaggcattaaattattacaatgataatataaaaagagttaaagaaaaattagcaaaattagagaagacattgttagttttttcaacgttaagatttataattgttattttatgtattggaatgatgtattatttctataagcaaaatagtatagaggcaataggaggcagttttttaatttccttaatattatttataatagttgcatttttccataatgaacggataaattgcaaaaaaaggttactagttatattagagtataatgaaaaaggactaaagagattagataatacttggaaggaatttagtgatataggtgaagaatttattgatagaaatcataagttttcaagtgatttagacatattcggtaaaaactctttatttcaatggattaatttaactaagactaagtttggaagaaaaaaacttgctagtaagatgataatgaattcattacctaataggtatgaaatagaagaagagcaagaagcaattaaagaattagcagataaaagggagttctgtgaaagaatttattttgaggcaagtatagaaaataagaaaaaagaaaaacttaaagaattgttagaatgggctttaagtgaagagaaaaataattttacagttaaatatatatcatatatatttattgtaattacatgcataatattatttttaaccattattgggcgattatccatttcatatttaatattagatttagttattaattacttagttattaaattgttaacaaaaagattaagtgatgtaattgatatttttataaataataagaaagatatagagaagtacagtaaattactttcaattatacaagatgaaaaattttattctaaaaagctactagatattcaaaaggatttagtaagttcaaatattaactgcaagagtgaaatgaaaaagttaaaaaatattatttcttggttaggggatagtacttctaatgcctattatttattaataaatgtattttttatgagtgatatttttattttaagtaacttacaggagtggagaattaaaaatggatataagttagagaaatggcttgaagatatgggagaagtagaagctcttgcaagtctttctacaatagcgtttgaacatgaagaatggacttatccaactatttcgggagctaatgaaattgaagctgttgaattagcacatcctttattaggagaaagagcgaaggctaataatttcaaccttaaaggtagtgagaaggttgcattaattactggatcaaacatgtcaggaaagagtacttttttaagaactataggatttaatatggtacttacttatttaggattgcctactttttcaaaaagatttaagtgtggaataagtaatatttatacttgtatgagaacacaggataatttagatgaaaatatatcatcattttatgctgaaatattaagaataaaattagttatagaagcagcacaaaatggtgaaaaggtatttttcttattagatgaaatatttaagggaactaactcgcaagatagacatgatggtgcgagaattttaattgaacagcttgtaaaacttcaaggtgtaggattggtatcaactcatgatttagagttatgtgatttagaaaatgaaaaaagttggttagttaattataatttcagagaatattataaaaataataaaataaactttgactatgtacttaggagaggtatgagtaagactcaaaatgcaaaacatttaatgaagttagcaggtattgatatagaagagtaaagagagtgggggaataagggtggcttttataataattgatttagagtttaataatctaagtggtatacataaatgtataccaaatgtttataatgacaatccaaatttaaaaaatttagatttggataatgaaataatagaaataggggcagtaaagttagatgcacatatgcagccttgtgaagagttaaaggtatatataaaaccatctgttattccagtcataaatcctaaaatcttagaaataactaaaattaatattaaagatttagaaaatggagtaggatttgttgaggggattaacaaattgaaagaaatggttaatgagggagatatcatttgctcatgggcaaaggatgatattgcagaaataataagaaatgctaattactatggatatgatgatttaagctggatagataattatttggatattcaagagtatgtaactaaaatacttggatatagaaagtcattaagtttaaaaaatgctcttaaagcattaaaaataaaagtaaatgaagatttattacatgacgctttaaatgattgtatttacacagcgcatgtgtttaaaaatatgtataattcacgagctgtgaaaaattacatagtagaagatatttttaaaatgccagctttagaagtaagatcattagaaggtattgaattaaattacgaaaaaataaatcaagtgtgtccaaaatgcaaaaagaagttagaaattgattatccgtttagcgtagttggatggagatttatatcattaggcacttgttctaagtgtaatagtagggttttagatgaacttatagtaaagaaaagtttatgtggtgaggagatttataaggaagttgctactgttatagatgaatatgattatctaagatatgaaaataaattaaaaaataaaatttataattaataatgaataaaataaataaattattaaaagttttatgatatataacatttacattttatatatgataaaattaaagagaagtaagatttaaaggaaaggacagaagatatgaatattgcatttcttttaactcctaaaagtgaggttatttatgaatatatagatgcaaccatgagacaagtaattgagagaatggagcatcatggttatacggcaataccgttaatagacaagcaaggaaagtatgtaggaactttaactgaaggtgatttactatggaagttaaaaaatacagctaatcttaattttaaaaatactgaaaatgttaaagtaagtgaaatagctataagaacaaagcataagagtgtttctattaatgctgatgtagaaagtatcattagattagcgactactcaaaacttcgttccagtggttgatgatgaaggaatatttattggaataataaaaagaagtgacataataaattattgttataacgctattaagaaagaaaaagaattattataatataaagtgaaattcaaaatttaatactttgttaattgaacttactcagcgactgaaaggagtcgagtttcctaagtgaaattcaaaatttaatattttgtcaattgaacttactcagcgactgaaaggagtcgagtttcctttaatatctcccctatagggtagacagttaagataagaaatctgccattgtagggggattatataaacaaagtagctttttttcttcttttacttgtataaaatttactggtgacttaaaattgaaagtgatatgttttacaaaggagtgattagttatgtcagttgaattaaatgagaattcaatgggagatcttttaaatgaatttgatgtaaaaagaattaattcaggagatatattaaaaggtcaaattatagatgttaatgataaggaagcgactgttaatattaattatgcattcgatggtgtaatagctaaggaagaattagttattggagacgtttcacctgttgatgttgttaaaccaggagatatattagatgtatacgttatttcgccgaatgatggtgaaggatatgttaagctttctagattaagagcgcttcaaattactgaaaaagaagatttaaagaaagcttttgataaagaagaaactataaaagttattgttaaggaagaagttaagggtggattagttgcttactatggatctattagagtatttataccagcttctttagcttcaagagaaagaatagaacttaaaactttactaggaaaagaaattgaagtaagattaacagaattagatttaagaaacagaaaggttattgcttcaagaagaattttagaagaagaagcttacaatataaagaagaaagagctttggaaaagtgttaagagtggtgaaaaaagggaaggtacagttaagaagataataaaagctggtgctattgtagatattggtggaataacaggattaattcacattaatgatttagcttgggaaagagttaaaagagttgaagatgttgttaatgaaggagataaggttacggtatttgtaggtgatgtagatgctgaaaatgaaagagtctcactaatattaaaagatgtagataaagaaccatggaaggtacatgctgatagtataaaagctggagatgtattagaaggtaaagtagttaagtttatgtcttttggtgcatttgtagaattatttccaggtgttgaagggttagttcacatcaatgaaattactgatgaaaatatagctaaaccttcagatgctcttgaagttggacaaatggttaaagttaaggttcttgatattaataaagaaaataagagaatttctttaagtattaaagatgctgttgaaagatcaaatgaatacttacaatacaatgataatgatggtgacgttacactaggagatctattcagcgggttattcaattaattaagggtaaatgtaaaaaagtaatgatattatctacaggaattagtataattttcgttaagaatttatatcctccttttcataaaatcattacttttttattaagcttaggtaatttgatttatgttattagaatagtcagtgttaggttaaagtttagttaactttgtggaactagaaaaaaattaaatgttatatcgaagggaatattgaaattgagccgttgaattatataaattcaaagtgagatttcattaatcacgtagagataacatttaattttttcgttagtcaatcaagaacctatagtttttcgattttaagcatatttgttccaccagtgtagtttgttggcataccagcagcaataataatgtcgtcacccttatctgctaaattcaattctgtaacaatcttttttgattcatttaaaatatcatcagtagttgcaaattcttcacataaaacaggatgaacaccaaaatttaagcttaatccacgcattacttcttcgtgaggagtaatagcaattataggacattttggcttatacttagaaacaagttttgctgttgaaccagagttagttgcagcaacgattgctttagcattaagaacattagatgttctacaagtagagtagctaatagcttcagcaaaatcatacattgcaggttcttttaaacgttgatttaaataattataatctaaatgaagttcagtttctttggctattttagacatagttttagctgcttctattggatattgtccactagcactttctccacttagcataattgcatctgttccatcaaaaatagcattacaaatatcgcaagcctcggccctagtaggtaaagaatttcttatcattgaatcaagcatttgagttgctgtaattactattttcccagattcattacatttttttataattttcttttgaataataggaaccttttctattgggatttcaacacccatgtcacctctagcaaccattattccatcagcttgttccaaaatagaatcaatattatttacaccctcttgactttctattttagctatgatttgaatattatttccattattattattgagaagttctcttatttctttaatatctgaagcttttctgataaaagaggctgctacaaaatctacacccatcttacagccgaaaactaaatcagccttatccttttcagttacagatggtaaattaatactgacattagggacgttaacgcccttgtgatttttgataactccatcatttaataccttacatattatatcttttccttttatatcaataatttcaaagttaattaatccgtcatcgactaatatagttcctccaacatttacatcctcatataattgagagtaagaaatagaacattcttgggcattgcctaatatttcagtaccacatttaaaggtaaaggtttgatttgcttttaattcaactccatcatttatgaaattatgagttcttattttagggcctttaatatcaagcattattgcagttggggtattaaggttagttcgtattttttttattaagtctattttttgtttatgagtttcctgtgttccatgagaaaaatttaatctagctacattcataccaattttaataaattgcgtcaaagtatcttcatcatcacttgctggaccaattgtaaaaatcattttagttttttgcataaaaacacctcactttatcaaaaataaaaattataaaataataaaataaatttgttttatatagattatgttgcactaattgatatataattattttaacataattaaacagtgaggagacttaaaaatgaaaaatttacaaaatttagaaccaaaagcggtttttgagtattttgaagagatttctaatattccaagaggatcaggaaatgaaaaaggaataagtgattatttgttgaactttggtaaaggattaggtcttgaaagcatacaagatgaagcattaaatgttattataaagaaaccaggtacgctaggatatgaaaatgcacctacagtaattattcaaggtcatatggatatggtatgtgaaaaaaataatggcgtagagcatgattttgaaaaagatccattaaaattaagaatagttgatgattatatatatgcaacagatactacattaggagcagacaatggtatagcagtggcttatgcaatggctatattagcctcaaatgatattccacatccaccaatagaagtattattaactactgatgaagaaacaggaatgtcaggggcaatggcaatcaagaaagaaaatttaaaaggaaagattttgattaaccttgataatgaagaagaagggtatcttttagttagttgtgcaggtggaataagaagtacagctactttaaatatagatgagcaagagattgttagtaaaaagttaataaaaattaatatatcggggttaaagggtggtcactctggtatggatataattaaggaaagaggaaattctaataaaatcttaggtagagtacttaagggattatcaagagaagtgaaatttaatcttgttagtttaaatggaggatctaaaaataatgctatacctagagaggcagaagcaataatagctattaatgctaatgacgagaatactgcaatagaagtaataaagaattggaataatattattgaaaatgagttaagagcacaagatccaggcttaaaaattgaaggatcagtaactgatattaaatcatacaaagagtttacagatgaaagtacaaagaaagttgtagatttactatacatttatccaaatggaattaatactaagagtacagaaattgaaggattagtagaaagttcaactaatttaggagtgttaactacaaaagatggagtagtagaatttgattcagcgattagaagttcaattccatcattgaaagaagaaatagttttaagaagtaaaactatagtagaacttttaggtggaaagtttgaaactacatctgattatccaggatgggaatatgatcctaattcaaaagttagagatatatgtcaaaaggttcataaagatatgtatggaaaagaagcaaagattgttgctatacatgcaggagttgaatgtggattatttaatgaaaaacttggtgacttagatatgataagttttggtccaaatctttatgatgtgcatactccagatgaacacatgagtatctcatcagttaaaaattgttatgaatatttattaggaatattgaaagaaataaagtaataaaaaaaagaattaaatttagatttaataaatttaaactttagaatttattttaatgaagacttgttaattagaaggtgtctatttgacacaatacaattaaccaggtcttcatttttgttattatgaaaaatatttttagtacagtataagtaaaagattgaactttaataatttaatttacaaactggtattggaattaaaagtttttattatgtatatataagataaataatgaatatattgtaatgtaataagtaaaagttttagaaagttagagatggggtggatgagaaagtgaggtatacaaggtataactataagaaaagtaaaaaaaatagtggacttgcaaaaactatattatcatttttagctatgagtgtatttgttgtaatcgttgggataatgcttgctaatataattgtacattttttaccgttaaatgatgctggtgaaacgcaagcgaattctggaacggtaaatcaaagtgaaaatattgatagcggtgaagcagaaaatgtagttgataatagtgaagatgttcaaacaagtagtgaagttgataatagtacacaaggtcaagaaagtgcacaaggaagtataaatacaagttttatggcaattcaatgtgggtattttgctaatgaggataatgcaaaagaggcgtatagcaaagtatcaaatgggtatggtgcttttatatataatgaatcagataagtttaaggtaatagctggattatatacatcagaagaggggcaaacaataatggacactttaactagtaacggtatagaatgtgctaaggtatcatttgatttaagttcaagtgataaagtacaaagtcaaattgctggaatttataatgggtatttaaatatattagatatggcattcaaagatgatgtaaaatcagtagatacatcagattttaagaaatgggtcaaagaacttgatgtaataaatgaaggggataaaagtgatgtattaactgagcttaagaatcatattaatgatatggcatcagaaataaagaaagaagacgtagcaaatgaaatgcaatatttatacaaaattttattaagttttagttaattaaaaaaataatgacattaaatatcaataattgtaaaaaaattaagaaaatcttaagggaatatatataatattctacaaaaaattcatatataaaaagaggaaagtgcttgtttgaacatctattaagtgataaactatattagaaaaaagataggtggcaagtgttttacctctttttttattatgtttaaattaaattttaaagtcaagtgtaagactaacgtttaattgggaataataaataataaataactgtaggatgtgatatgtttgaagtttatattagcatctgcttcggatcgtagaaaagaattattatcaagaataataagtgattttgaagtaaggattagtgactttgatgaggagacagtagcggttagtaaaaacattgagaaatatgttaaaacactcgcagaaggaaaagctaaatcagtagcattaaattgtactaatgattctataataataggggcagatacaattgttgttatagatgataatatacttggaaaaccgaaggataaagatgatgcgtttagaatgcttaaattattaggcaataatgttcataaggtttattcaggagttgcagttattaacaatgaaaagcaagtaatggaaagtgaatgtctttatacagaagtttatttttcggaactttcagatgaggaaatatggagatacatagaaacaggagaatgtttagataaagcaggagcctatggaattcaaggttatggtggagtatttgttgaaaaaataaatggctgttactataatgtagtaggacttccactaaacttattaaacaagatgataaagaatgttttataattagggggaatgggtatattattacttataaggagtatttatgacgaataatattagggtaaatgatataccattaaatgagagacctatggagaagttacttcaatttggagttgatactttatctaatgaggagcttttagctatattattaagaactggtacaaagggagaaaatgtcatagctttaagcaggagattgcttgctgagcttgatggattagacggacttttaaatgtaagttatgaggaagcaagtaaaattaaaggtattaaaaaagtgaaatcttgccaaataattgccatgatggagttagttaataggattagaacttttaaatctcaaaaagagatagttagaatttcatcacctaaggatatcgcaacattattaattaatgaaatggttaatttaaagcaagaagtatttaaattgattttattaaatacaaaaaatattgtgataggaactaaagatatatttaaaggaacattgaactcatctatagttcatccaagggaagtttttaaggaagcaattcaaagaggaagtgcaaatgtaatagtttgtcacaatcatccatcaggagatcccaatcctagtaaggaagacattgatatcactattagattaaaagaatgcggaaatattataggaattggattgttagatcatattataattggtaataataaatatgttagtttaaaagaaaaaggaattatataatcgaaaggggaattcatatgggatttttcagtagtaataaagatatgggaatagatttaggaacagctaatacacttgtttttgtaaaaggaaaagggatagtattaagcgaaccttcagttgtagctataaatagtaatacaagaagacctttagcagttgggcaagaagcaaagcttatgattggtagaacaccagggaacattgtagcaataagaccacttaaagatggtgtaattgcagattttgaagttgcacaaactatgcttaaaaagttaattgaaaaagtaacaagcaaaagtgcatttacaagtccaagaattatagtatgttatccatcaggtgttactgaagttgaaagaagagctatagaagaggcggctaaatttgcaggagcaagagatgtagttttaatggaagagccaatggcagcagcaattggagcagggcttccagttggagaaccaacaggtagcatgattgttgatattggtggtggaactacagaagttgctattatttctttaggaggaatagtaactagcaaatcattaagagttgctggtgatgagttagatcaagcaataatagcttatgttaaaaaagaatttagcttaatgataggtgaaagaactgctgaacaaattaagatggaattagggtcagcttataagattgatgaagaaaatgcatcaatggatattaagggaagagatatgataacaggacttccaaagatagtgacaataactgaagatcaaataagagaagcattaaaagaaccagtttatgcaattattgagtctattaaaactactttagaaaagactccgcctgaattatctgcggatataatggaaaagggaataatgctagctggtggaggagctttattaaagggactggataaattaataaaccacgaaacaaatatgcctgttcatatcgctgaaacgccattagattgtgttgttttaggtgcaggtaaagcactagataattttgatgaattaagcaaaactcaaagaggtcaataatgaaaccttttaaaaacaaactggcagtaactatagtggtactgtcagttgccttttttgggataattgtatttagtataaagagcaattcaaatattatatctagtggtgttggtggtgttattagtccattacaaaagattgtttatacaataaatgaaaaagtaaagggttcctttgatttttttattaacttttctaatgtaaaaaaggaaaatgaagagcttatagcaaaaaatgctgaacttgaaaataaattaatagaatacgaaagaatgaaagatgaaaatacaagattgagagaaatgttcgattattcacaagctgatgaaaattatgattatttaggatgtaatatcattggctatagtggaggaaatatctctaatggatatataatcgataaaggaactaaagatggaattgaaaaggatatggtggtaatgacacctgccggattagttggaaaagtaacaaaggcatcttcaagttttgctattgttcaaactattttaaatgaaaatattgcagtagcagctatggttgaaagtactgatgaaacaacggggattttacaaggtataacagatagtaaaaataaaaaattaactgaattatctaatattccaattgattccgcaattaaagaaggagatataatattgacttctggattaggggaaatgtatcctaaggaaattagaattggagaagttgtttcaatagaagtagataatgtaggaattatgaagagagcggtagttaagccatatgtagactttaataagcttgaagagttgtttgtcgttgttccaaaagaaaaggttgatattggagaatagagttatgaagaggatatatttaataattatattaatactattattgattatagataatactttattacctagctattctatcgcaggagcctttccaagtcttttatttgtattttctatggcatattctgttattacaggaaaaaaagaagctgtttttattggaatagtaagtgggtttcttcaagatttatttttcttttcagggtttggagttaatttatttctaaatactttattatgtcttttatgtgctaaagttggagaaagtatatttaaggaaaatagaattgttccagtattaatagcgttatttgtttcaactttaaaggttttaggggtagttataatatttaagttatttgccgtaagtattgatatgaaagtagctttgttatcggcagtattaaatactatttgtatgatgcttttctatagatttattttaaatatgttagataaatatttagatagaaatacatggaggttttaatggtagtaaataaacctaaaaaaaagaaaaagaattctagatactctgttttatatataattatgtttataattatggggactatagtagcaaaattattatatttacaagtttataagcatgatgactataaagaaaaagctgatgtaagttcaactaagtttatttctgaggaagcaccaagaggaaacatttatgattctgatggaaatataatagcgactaataaacaaacatatgcattaacatatatggaaactattgaatcaactaaagccttttacaaaactatggacaagatatttgaaatcttggaagaaaatggagaagaatttcaagatgatttagcccttaaagttgatgagagtggcaatatatattttgagtttaaggcagatagtgaatcagctagaagaacattagaaataagatttaaacgtgatagaggattgaatgaagatatagaaacagaactttttgaaaatcaagaaggcgactatacagatgaacaaataaatcaagttaatgataagcttatggaaatatcggcagaggatacattctattatatggtagaatcttatggtttatataagttattattaccagaaggatatacttctgatgaggcaacagcaatggctaaaaagtataaagatgcaactggccaggaaatattagatgatttattaaaagaatactcaattcaagatattagaagatatattgttataaaagatgctataaaaatgggaagctatagtggttattctaatattacaatagcaagtaatatcgctagagaaactgcatttatagtatatcaagaactgaataatttaccgggaattaatgttactttaaaaccagttagatactatccatatggtacattagcatcagctgtagttggatatgtttcttctattagtagttcgcaaagtgaaagctatgaattaagaggttatgatgtatcaactgatttaattggtgtatcaggaatagaatccgcttttgaggaccaattaaaaggtacaaaaggtggaactactgttaaggtaaattcacaaggtagaacaacagaagaattatttaaattagaatcttatcaaggaaataatgtacacttaaccatagataaggatgttcaatatgcagctcaagcagcattagaggaccaaatacttacattgcagtcagagggattaacgagtgctactagaggtgctgtagttgcaatagaagttaatacaggaagagtaattgccatggcaagttatccgtatttcgatcctaatgattttgcaattccaagtgaattaagtacagaaaaatataatgaatactttaatccagactatgagagttttggaacacaacatattcaaagcacaggggcaacaggaactttagatgaactttttaaagtaaatgaagatactggtgttagagaagatacttatgatatttatccaagagctatgtttaattatgcaactcaaggattagtagtaccagggtcaacatttaagccgttaacagctttagcaggattgatggatggagcaataagtgaaagtgatactgttaatgacgtagggatttggagtagtgattatacaggaagtcaaactcttgaaaacttccaaaagacaggtcatggaattacagatgttagaaaagcacttgaagtttcttcaaattatttcttttatgaaactgcaattagattatatataaagaatggcggagatgttgatgcccttgattctattgctcgttatgcatggaaatttggattaggagtagaacaagggaaaagtgcttcaactggaattcaaatttatgaaaactttgggcaaacatataattttgtatcatggagaaagagtttatcagaaaatgcaaagtatactatagtaccagctcttgaggctggtaattatgaaaatacttatttctttgttccttttgatataaaagatattagtactgatccagatgaattaaaaacattaaaaactaatttaaaaaataatattaaagaaactttattaaaagttggaactgatgaacaagttagtgggcagacagaatatgctaatagtataattgatatggttaaggaaataatgaatgtatcagatagatataaagaaaatttagctgatgcaggattagaatattctgaaaaagttgttaatgaacaagctagaacagtatcaaatgcaatttcttattttattgttaaccaaagttctgaaataagatcaccaataaatatagttcaagatggtattggtcaaagtatgaatgcatttacaccattacaaatggcgaattatattgctactttagctaatggaggcacaagatataaagtatcaatagttgataaaataacatcgcctgatggagaaattattcaagaatatactccagaggtattagatcaaattgatattccatcagatgtgctacaagctataaaagaagggatgagaagagttaatacttcaacatcaaatgcaactgcttatgcattattttctaattttcctatagaagttgctggtaaaactggtacagctgactttggtacacaagaacaatatgattaccaaggaagaaaggcatatgcaaactatataagttttgcacctatggataatcctgaaattgcaatattctctactatttatgatggtaataggggagctaatagtgcatttgttcataaggcgatatatgaagcttattttaaggataaattattacaaattaatccgaattatgcatctatatcagcaactttccaaaaatatgttattggagctccagcagacaataaagaaggatcagaaactgaggaagaatctacaattgaaaatatagaagatttaggtacgactgaggaaagtggtcaagaattaaatatacctgttgaaaatggagcgggtgcagattaagcaagagagcctttaaataggttctcttttttgtgaaaaatttgttgtttcaatttattttctttacttaaaagagtagttattttaaaataaacaatgatcattggtaaaataagtgatattttacaggaaaattacagcactttgaagctgattatgtttttaattgttgttatatgatataattaatattaaagtgagttattaattggtggaggattgccaatgaaagatgatagaatacaaataaaagggaataaagatggtgtgaatgttactattgatatagaaaaatttatatgtttcgatgatatgcttgaagtattagtatctaggttatcagttaataaaggcttttacaaaaattcaatattaaaaattatatctaattttgaacatattagtaactctgatataagcaaattaaagaatgaattatttcaaaaaataaatataaaagattgtgtttttgatgatattagtaagaaaaaagaagaaagcaataatattaaagtttttaatggaattaatgaaggaaaaactaaatttatcaagaaaacaataaggagtggacaattagttgattatcccggcaatattattataataggagatataaataatggtgcagaggtatcagcaggtggaaatattatagttcttggaagtataagggggcatgttaaggctaggactggtggaaataaaaaatctataatagctgcattttcaatgcaaccagaattaatgcaaatatcagatatacttaccgtaccaccagatgatggtattaagccatcttatccagaagttgcaaagataaaagatggttacatagtagtagagccatacttaccaaataaatatatttactaaagtggagggattgacatgggaatttcgatagttgttacatcaggtaaaggtggtgttggaaagactacaacaactgctaacttaggaacagcattagctgcattagggaaaagggtagtagttgtagatggagatacgggacttagaaatctagatgtactaatgggattagaaaatagaatagtgtatacaattattgatgtaattgaaaacagatgtagattaaagcaagcattaattaaagataaaaggtatcctaatctttatcttttaccaacagctcagactaaggataaagatgatattagagctcaagatatgtttgatttagttaacaaattaaaggaagagttcgattatgtattaatagactctccagctggaattgaacaaggttttgaaaactcagttgtaggtgcagataaagctattgtagttgtaaacccagaaattacatcagtaagagatgctgatagagtaattggtaaattagatgcaaaaggattagaagatcatgcagtaatagttaacagattaaattatgaaatgactaaaagaggagatatgcttgatgtttcagatattatagaaactttatctattaagcttttaggggtagttccagatgatagaagtataactgtttcaactaataaaggtgagcctatagttttagatgaaaaagctcaatctggtcaagcgtttagaaatattgctaaaagaatcacaggagaagaagttccattacttaagttaggttctgaatctactggaatattttcagcaataaaaagaatgtttaagaaaaattaggggggattggtcattatggattttttaagggtattttctaataagactacaccaaaagaagttgctaaagatagattgagattaatactaattcatgatagaggcgatatagctccggagactttagataagattagatatgaaatattagatgttatttctaagtatatagaaatagatgctgatgatgttgagatttcattaaatagaagtgaggacgttgagggtgaaggaggacctgcattaattgcaaatattccaataaagagtataagaggaagataaaaaataggtgtattaaaattataatgtcaacacaaagtgaataaagatctaagctaggtacaagtagctagtcatgagttgaggttgaaataccttgaggtgtttttttaaattgtaacttgctacttgaaatttctcgctatcttactggtgtgttagcattatttttttgatacatttttttatttaaaaaaatgaagcattcatagataatcttaggatacatatactatttttgtgtttaatatttaaagtaaattaattcttaaaagtttatgaattttatatggaacagtataattctttatggagaaaaaagaggaaataggatataataagtaggtataaattctaggaggtaaagttatgatacctttatcaaagtttaaaatgagtttgaaggaactgaaaagggtagataagtggatgctaatatcgataatattaataacgatgtttggcatagttaatatatatttagcaaagaaaacatctactggaggaatgttatttccagtgaaacaaagtattttctttgtggcatcattagtattattatactttgttgtagcaatagactattcaattataaaagcatttacaccaatattttattggggatcaatagcgttattggtattagtattattaataggatcaacaattaatggagctcaaggatggataagattaggaccgttatcattccagccagcagagcttgcaaaaattgggacaataatgatgatgggtaaaaaattagatgatatggaaggtgaaataaataattttaaaaatttctgtatattagctttttacgcaatagtacctgcagcgcttattgtcattcagccagacatggggatgacaatggtgttattctttatggttttaggagttttctttattggaggactagatagtaggataatattaggtggcttaggagcactaatagtaggtatagttttagtatggaattcaggattaattcaagattaccaaaagagaagaattacatcatttcagaatccagaagcagattcatcagattctggatatcacttaagacaatcgcttatagcagttggatctggtggtttttttgggacattgaattctttggctaatgatggaaccggaggctattcctcacaatatgttccagaaattcaaacagactttatatttactcagctttgtgaacaatggggaacttttggtgcaatttgcttattaactctatatggaatattgatttcgagaatgattaatatagcacgggattctaaagatatttttggaagaattatagcaacagggatggtagcgtacttcttatttgcaatatggcaaaatataggaatgacaatagggttaatgcctataacaggaataactcttccattagttagctatggaggaagctcattattaactacaatattatcattagggttagttataaatgtaggagtgagaaagacaaaacttaatttttaaatatcgggatatgcaatatgttgtaatacaatatattgcatattttttttagttgcaaaatataatttaataatcaatttttttagggaggtagaaatgggaaattataattcacaatataaaaattactatcaagggttgcaaaataaaaatgtaaagaaaaagaattcagcagtatatactagaaattcctttgaagagatatatggatataacaataataaaagaaaaaagaaagagttcttttcaagtatgtctaatgtttttatttatcagttagttgtagtcatttttatgttgatggcaagtttttatttgaaatatgcaccaggtcaaaccggagcatatgaaaatgtcaaagcagtaattaatgatacaacttatagtcaggttgagcaagaagtagaaagttttgatttatcgaagatagttaataaaataagtaattacataaaaacaagtttaggtggggataaggttgatttttaatgtctatctgatggctagccgttgtaacattccaatctttttagctggaagataacaatggatgcgcctctagactaggtacttttttggtataatgaattctaacattaagatagggttaaaacttcattttaagataagaattaagtttatacaatggtattaaggaggttgatggtttactaatggtttgactgagaaggagaggtaaatggatagatggaaaaaaggtgttttagcagaatttatagtattttttatacttttaagctttaacaattcaattattttagcatttataagtatacttgctcatgaagggatgcatatattagttgcaaaaagaaaaggttgtaagtttaatgatattcaggttcatatatatggaacaagtgctcagtttgctaatatagatgaattaaacaaaaaggaaaaactgcaaatttatttatcaggtccttttgctaattttataattatatgcatatttttgtgtgttggttttgtaagtaataatacattgatagataaaatgattaatattaatctaagtttattatttttcaatttacttcctgcttatccgttagatggatcaagggtattagaaatattattatctcaaaagatagtgtatagacgagctaatgatataatttccaaaataagttatgcaataggagctatattattagctatttttataattgtatttgcatataaaggtgtaataaatgtaagtatacttatcgctgcaattgctatatgtttaattacaagaagtgaagaaaaatcagctatgtatatattgatggggaatatatttgtaaaaagaaataaattattaagaaataagtatattgaaaataaaagtatatcagtttactataagcaaggtcttgctaacattatgtcgatagtagataaaaatagatttaatatattttatgtattagatgatgatttgaaagtagtatttattatgaatgaagatgaattaatagaagctttaaaattgtatggaaatattactttagaggaatactttggtttaagaaataagagtgggtattagtttactttttaataatgattatgctagaataacatttagatagttagaagttaagagttagtagttagtagtggtgaaaaattcggcttaagctgaattttttagttaactactaacttaaaactattaactaaattagaggagggtacttatgaataagatagctgatgatattttatgtaaagtagaaaagccatcaagatatattggtggtgaattaaatcaagttataaaaaatcctgaaaatgttaatgtaagatttgctttttgtttcccagatgtatacgaagttgggatgtcacatttaggaacaagaattttatatcatactataaatgaaagaaaagatacatattgtgaaagagtttttgcaccatggccagatatggaagcattaatgagagaaaatgacataaagttatttactttagaaactaaaacatcattagataaatttgatatgttaggatttacgcttcaatatgaaatgagttatacaaacatattaaatatgcttgatatgtcaggaataactattagggcaagcgaaagaggagaagaagagccaataattatggctggaggtccttgtgcttacaatccagagcctttatatgatgttgtagatttcttcgaaattggtgaaggagaagaaatgatgaatgatgtcttagaggtatactcaagacataaagctaatgggaaagtaaataagaaagagttcttaagagaaatatcaaagataggtggtatttatgtaccttcattatatgatgttacttacaatgaagatggaactataaaagagtttacgcctaagtatgaagatgttcctgctaaggttaaaaagagaatggttaataattttgatgctgtatcattcccagaagaaatgatagtaccatacactgatatagttcatgacagagttgttttagaaacagctagaggatgtactaatggatgtagattctgtcaagcaggtatgatttacagaccagttagagaaaagactacaaatacattattagatcaagctagaaaggctcttaaggctactggatatgatgaagtatcattatcttcattaagtatttgtgattactctaatattcaaaatttaatatctagtttagttatggagcatgaatctaataaggttggtatagcgttaccttctattagagtagatgctttctcagttgatttaattaaagaaattcaaaaagttagaaaaacaggattaacttttgctccagaagcaggttcacaaagaatgagagacataataaataaggggttaactgaagaaagaattttagaagctgctaaaagtgctttcgaatcaggttggagtactattaaattatacttcattttaggacttccttatgaaactacagaagatgctgctggaattggcgatttagcagaaaaaatggctgatgtttattttggaattccaaaggacgttagaaataaaggattaaaaattactgtaagtacatctatattagttccaaagccatttactccattccaatgggctccaatggctagacctgaaatagttgatgaaagaattaaagctgttagaggagctattaaatcaagaagtatagtttataactatcatgagcaagaaacttcatttatggaagctgtatttgcaagaggagatagaagaacttgtgatgttttaattaaggcatttgaaaaaggtgctaaatttgatggatggtcagaatacttcaatatgcaaatatggaaagaagcaatggaagaatgtaacttagatgctgatttctatgcatatagagatagaggatatgatgaagttcttccttgggatttcatagatattggtgttaatagaaaataccttgaaagagaaaatgaaaaggctaagagagctgaacttacaagaaactgtttagaaggctgtactggatgtggaatagatgtaaactttaaagaagggaagtgttttgaaggtgcgatacgtaattaaatttactaagggggctgatattaaatttattggtcacttagatttaatgagaactattcaaagaataataaaaagatcaggattacctgttgagtattcaaaaggatttaatccgcatatggcattatctatagcacagccgctttcggttggagtttattcagatggtgaatatttagatttagttttaacagaagctcttggtgtaggagaagttatagaaaaattaaatgaaagtgcccctcctacaattaaatttttacatgcaactccagttgaaataatagaaaatgttaagagattacctcaagcgatggcacttttagatggagctagatatacaattaaggtaaaacttaatggaacttctaaagtagaagaagaaatgtgtaaaactcttaatgaatctaaatgggaaattgtaaagaaaactaaaaaaggtgaaaagcttactgatataaaaccactagttaaagagtttaaatattgggtaaaggatgatgaattaattttaaatgctttaatagcaacaggaagtagagaaaatctttcggcagatcttttagttacttacttaaaaggaaaagtatcagaaattaatgctgaatctttcgttaatatcaaaagagaagaaatgtatattttaaaaaataataaatatgttcctttatataaaggaatttaaggtagttttaatatgagagaaatttttgttgagaagagagaagaattaattagaatagcagtaaaggaaaatggtgagttagttgaatgccttgttgaagaggaaactaatgagccacaaattggagagatttataagggaagagtcaaaaatataattccaggtattaattcaatattcttagatattggattagataaagaagcttatatgtattatagtgaagagcttaaaagagttggagttaaaaaaggacaagaaatcctagtggaagttttaaaggaacctttaggtaataaaggtgctaaggttagcaataaagttaatatacttggtagatatatggttttaactatgggagtagaagggattactatatctaaaagaatttctgacttagaagaaaggcagagactaataaatcttactaaacctattaaaggtgttgaaatagtatttagaacagaagcaaaagctgcaactaatgaagaattgctaagtgaattaaattcattactagaaaaaaaagaagaaatggaaaagaagcttagatactcaacaactattggaaaaataaaatcgaatagcatgataattagattttttgaagaattagatcaaagaaaaactagtataacagctgatgatcaggaatttcttaaaaatattaaggaattaattaaaagtaataaagagattgaatttaaattttatgaagataagagaactttatttgattatagtggaatagaaaaggaaatacttaaattaaggcataaaaaagtaaatttgcaatgtggtggatatattgttattgataaagctgaagcaatgtatgttatagatgtaaatagcggaaaaaataccaagggaagagattttaataagactataatgcaaactaatttagaggcagctaaagaggttggaagacaaattagattgagaaatttaagtggtattatagtagttgatttcattgatatgagggatgaaaatcaaaaagtacccgttataaaggcattaaaaaaatcattagaagctgataaaggcaatgttaaagtatttccatttactgagcttgatttaattcaaattagtaggaaaagaaaaggaaaatctatttatgaatatttagaagagccttgtaaaaaatgtaagagaaatggctttattttgaaattatcatatatagaaaatcttattagaaatgaaataataaaatgctctaaagaaaactctataaaggatttttacgtagagatagataaaaattatgaaaatgacataaatgatgatatagttaaatttttgaaaaatattgatggattagataaagaaatttatttaaattttgtgtatgatatagaggggtatagggttgaacctcttatatttgcatcgcaaaaggaaaattaccaaaattacaaaattaaaacaattgaaaaagcacaataaatttctttacaaaatgtaactttatatgataaaatgtcatatgtaaaccgcacataccgggttttaataaaaacaaagttaaatctttgtacctgaattggcgagaccgtttaagaggaggtgttttaatgtacgcagtagtagtaactggaggaaaacaatacagagttcaagagggagacgtagtatacgttgaaaaattaaacgctgaggttgactctacagtagaattaacagaagttttagctgtttctaacggagaaactttaacagttggtgcaccagtagttgctggagctaaggttgttgctaaggtagcagctcaaggtaaggctaagaagatcactgttttcaagtataagcctaagaaggactatagaaagaagactggtcatagacaatcttacactaagttagtaatcgaaaaaatcgaagcttagttataagttatgattaagattattatatttaaacaaaaacatatatctattggatttaagattgaaggtcatgctttatctagagaagaaatagaaagtactacaggtgatgcatatgacatgatttgtaatagtgtttcagttttgtctcaaagtactgtaataggtatggaggaagttttaaaactaccagtaaagtatgaaataaatgatggatttttatcactgaatttacgtaatcttaatgaaaaagatattgaagtagggcaagtattacttttaacctttgaaaaaagtttagaaagtttaattatgtcccttgacgctagttttggtaaaaatagacggaataaatatataaaaatgaaattcgaggaggtgtaatgagtatgttaatgatgaaccttcaattatttgcccacaaaaaaggggtaggtagttcaaagaatggtagagactctgaatctaaaagattaggtgctaaggctgctgacggagaattcgttttagctggaaacatcctttacagacaaagaggaactaagattcacccaggtctaaacgtaggtaagggtggagatgacactttatttgctaaagaagacggaatcgtaagatttgaaagaatgggaagagacaagaagaaagtttctgtttacccagtaagcgttgaagaaatagctgaataattatatttatataggtaaaagcacccgtaagggtgcttttattcttgtaatagatatataatttatatatactattataaaatatatatgttatggaataataaaaatagattattatgtttaacattaaaaagttacaaggaggaaagtaactatgtttatagatagagccaagatattagttagatcaggtgctggtggaaatggagcagttacatttagaagagaaaagtatgttccacttggaggaccagatggtggagatggaggaaaaggtggaagcgttatatttactgttgatacaggattaacaacacttttagatttcaaatataagaagaagttcatagctgaatcaggtggaaatggtatgggttcaaaatgttatggtaaagacggagaggatctatacataagagttccaatgggaactattgttagagattttgaaagcaacaaggttattgctgacctttcacataaagatgatacatatgttattgctagaggtggaaagggtggtaaaggaaactgtaagttctgtacaccaacaagacaggcaccacattttgcagagccaggtatgccagcagaagaaagagtattaactcttgagttaaaattacttgctgatgttgggttagttggattccctaatgtaggtaaatcaacattactttcaactgttacagcagctaagccaaagatagcaaattatcactttacaactttaaagccaaatttaggtgttgttaaagctgaagggataaattcatttgttatggctgatattccgggaataattgaaggcgcagcagaaggtgttggattaggccttgatttcttaagacatattgaaagaactagattattaattcatgtagttgatatttcaggtgttgaaggaagagatgcctttgaagattttgttactattaatgaagaacttaaaaagtattctgtaaagctttgggatagaccacaaatagttgtagcaaataaggctgatatgctttatgatgaatcagtatttgaagatttcgaaaagaaagtaaaagaattaggatttgataaagtatacaaaatgtctgcagctacaaaatctggagttgaagaagttatcaaagaagctggtagaatgttaacagaaattccagtaatggatttagaaattccagatgaagaaagatatgttgagcaagaaaagagattcacatatgaaattaacgttgaagaaggtgaagagtacaatacttatattgttactggatcattcgttgatagattacttgcatcagtaaatattcatgatgcagattcattaagatacttccataaggtacttaataataagggagtattacaagaaattagagagatgggcgtacaagatggagacatggttagattaaatgacttcgaattcgagtacattttataggaggaaattttatgataacaggaaagcaaagagcttatttaagagggcttgcaaatactatgagtccaatattccaaattggaaagaatggtgttgaagaaacttttttaagacaattaaaggaagcattagaagctagagaacttattaaaataaaggttttagaaaatagtggtttagcagctagagaagtttcagatgaaatatgtaaagctattggatgtgaaggagttcaagcaatcggtagtaagattgtattatataagaagtcagaaaagaaacctaaaatagaattgccacaaggaaaaaataactagttatgaaacgatatggtatgatggggggaacatttaatcccatacatttagcacatttatatatagcatatgaagctaaagaagtcttagagttagataaagttatatttatggtagctggtaatccaccacataaaaaggatagtccggtaatagactctaagtataggaatgatatggttaaaaaggctatagaaggttataaaggctttgaaatcagtgattatgaaataaagaaaaatgggtatagttatacctatgaaactttacagtatttaaaaaacttagatgatgttagtgaagtattttttattgcaggtgcagattcattaatggatatagaaaagtggagaaatactgatttagtattagaaaattgtactttcgttgcttttaatagaggagaatatactaaagatattcttgagttacagaaatctaaattagaagaaagatacaatgctaaaataatattacttgatgtagccaatatagatatttcttcatcaatgattagagaaagaatagctgaaggaaaaagagtagactttttcttgccagaaggagtaatgacgtatataagtgaaaataatttatataggagagagtaaaatgtggggaatagatgaaataaaggattatttaaaagataatttaaaaccatctagatatggtcataccttaggggtagtaaaaactgctattgatcttgcgaatatttacaacgaagatgttaaaaaggctgaaatagctgcactttgccatgatgtagcaaaaaatatgagtagtgaggaaatgctaaaaataattaaagatgaaaatattttattatcagtagatgaaaaaaatactgaagaattatggcattcaataattgcacctattttaggaaagaaaatttttaagatagatgatgaagaaatattaagtgcaatgagatggcatactactggaaaagaaaatatgaataaattggaaaaaataatatatttagctgatttaattgaaccttcaagaaagtttgagggtgtagaagaaattagagcgatttctcgtaagaacttagatgaagctatgttaaaagcattaactcatacaactatgtatttattaaatcaggactgtgcagtagatgtaaattctgttaaagcaagaaattatttgttgtataatagataagtaaatacaattatatatttagtttataaggtgagggatgggcaatggcaggaaataaaaaaagtgagaaacaaaatgccagaaggggatcgaggcaattaagtccaagggaagaacttgaaattaaacaaaggcttaagagaaaagaaaaaaaatcaactgttattaagagagcaattacagctttaattttaacaatagtggtacttggtggattagttggagtatatttattttcatttgtttcatcgcttaataataatgatatcatatcagcagtcaaaccaagttcaaatgaaactgtaaatatattattgcttggaatggatataggagatgcagaaaatacttctaattcatcagcaagaagaacagatactatgatgctgattaactataatccacgtacagataatataaacgttgtttcaatacctagagatacattaatagaagtagataatgcaacagatgggaatggaaataaaattccttattggaagataaatgcggcttatgttttaggtggagaagaagaggttatagaacaagttcaaaatcttttagatgtacaaattaattatttagttgaaatagattatgctgcctttaggaatttaattgacgctattggaggagttgaaatgtatattgatagagatatgtattatgatgatgatgcacaagatttacatatacatttcaatgctggtgaaacagtgttattagatgggcaaaaggcagaagagtattttagatggagaaaaaataatgatggaactggacttgcagaaggtgatttaggaagaattaaaaatcaacaggcatttatatctgcagtaattgaaaaatgtactagtccagaaattataacacagattccaagtattcttaagtctgtaaaagaaaatatagtaactaatatgtctggaagtgatatgatttactatggattgaagatgattaaaaatgaaggaatctctatgaatactttacaaggtgataatgaaagaatttatgggcaagatttcttggttatgaatccatcatataatcaaagtttattagaatcattaaagataacaagtgaagctgataagactgcagacagaactggtcattctataatggttttaaatgctactagggtaaatggattagcaggtaatttgagaatagaattagaaaacttaggatatacaaatattagcgtaggtaattatgataaatcaaaggaatctaagatactatctaatgataaagaacttaaaaagctattaagtgaagatacaggaattaataatctttcaagaaataaggaagaagaatatgaaaattatgatgctgtaattattattggagaagattatttaacatttaattgataaacttaaggttagcaagaatcataattaactttaagtttgactcttaactttagggaggaaaacatgagtactttagagaagtgtgtagataaagcctttgatggaataaagataagagaatacttaaaagcagagatgggattatcatcaaggcttattagaggtgctgctttagataaaagaatattagtaaataataatccagttaaaatgaattatgtattaaaggctaatgataatattttaattaaccttaagaaaaaggaaagtcaaaatatagagccggaaaaaatagatataaatatagtatatgaagatagcgatataattgtagtaaataaaagacctaatatggtagttcatcctactaagcgttatcaatcaggaacattagcgaatgcattattgtattattttaaggaaactaatcaagattgtattgtaagacttgttagtagacttgatatggatacttctggattaataataattgctaaaaatcagtatgctcatatggagttatcaaaggatatgcagcaaaatggaatagaaaaaagatatttagcattagttcatggtcatatggaacaaagagaaggaactatagataagccaatttatagaccagaaattgaagggaacatgagaagagttgtagatgaaagagggcaaagaagtattactcattataaagtagtagaaagattaagagatgctgatttagttgaatgcttattagaaacagggagaacacatcaaataagagttcatttaagtcacttagggcatcctatctatggagatactttatatggatttgaagaagatgctcaattaatttcaagacaggcacttcatgcatatggattaaactttaaatcccctagaacaaaggaacagctgcaattacgagctgatttacctgaagatataaaagcacttttagaaaagctaagagagagttaatataatacttagtatagaggtgtcttataaataattattttaatgaaaaagtctgccattaaggcagactttttcgttaaaaattatgtttatttcttatataagaacgtcttgctaaaaagctttttcgtctatttcttttacgtattgtaaaaatgataataataataactattattaaaataattccagatgctactccagaaataaaatatttattattagtaattttattaacagtatttttaactgcaacttcagttgtatattctctagattcaccactatctaattttatatcggatattttattaccgttaagtaaaagtgaagcattaaatagtgtttcacctttttttatagatgttttacttaaatctttatcttcgtaagtaacagataagttaatattatctttattttctccatttgcaagattgaaagtataataaatatcttcatcagcaagtaatggaatagtagttgaactatctaaagcataattatccaatttatcaccagctgttactattttttcagttttaaagttttcaaagccccaatcaaataattgaccaactcctgtatataaaccatctttatcagtagcatttaaaaatgaacctactatttcttggccatctttaactgcaacagcagcatatgaatgattagctgcaactgtatatccagttttacctacataagcatattgatatgtataagctccactttcttttaataaaggattatgatttgatgcccatttttcacttccatctgaataaggatgatttgcataaaaatatgatggggtttgtgaaattctaacaaagtctgaattttgagaagcatatctcattattaaagctaaatcatgagcagttgttagatgaccatcttctgttagtccacttggatttttaaaggtagtatttgttgcccctaattctttagctttttcattcataagcttggtaaattcatcaattgaacctgaaatatgttctgcaattgcttctgcacaatcatttccagattctagcagtaacccgtaaagcaattcttcaattgtataaacttcaccttgctctattcctatggaagatccatcggctttgggtggattttctcctatagtaacttgatctgtaagattacacttttctaatgctaatattgctgtcattatttttgttgttgatgcaggcatatattgaacatcagaatttttctcgtatagtacttgacctgtttttgcatccataagatatactccttcagagcatatattaggaaaagcaaaggagtttactacagtaatatttaacaacaatattgttgagaaaaatactaaagcaaacgttttaaatactcttttcttcatttttctctccctatatttcatagtttacttatttagtttatcaaaaaaggtgaaataattccacatataaatttacatattaagtttatatatggaaattatgttaataattataatgaggttaataagtaggtgaataaatggataatgtaaaagaaaaattaaaaaatatatttcaagagaaaaaaacaataggcttaacagtaatattaattttagctcttatagtttctttaatgacatatggaaagaataaaagtaatgtttttaaagatgaatatatgaataatatttttattgatgaaaatgataattctggagataaccaaaataataatagtgatgatgaaagtgaaatatttgaaggagattcaagtttaatagttaataatgcaaatattaatggacagaaagagaatttaattgttgtagaaattaaaggggaagttattaatccagatgtatatacgttaaatgaaggaagtataattaaagatttaatagaagtagctggaggattaactgatcaagctgatatttcgaatataaacagagcaaaagaaataaataatcatgagcttgtaataattagaaatattaatgatttagtaagtgatgaagagatagaaattaatgtaatgcaagaagtagagagtgatgatagtaaaattaatatcaatacggctgacttaagtaaacttaaagacattccaggcataggagatgtaaaagctaattctattattatgtatagagaagagaatggtggatttaaaacaatagaagaattaaaaaatgttgatggaataggagaaaaaacttttgaaaagataaaagacaatataaaaatataattcttaatgtgaattttaaataaataagttaataaacgcatttaaatgaaaggttattaatgttataattaataggatttaggaaagcataatattatgctaataaagatatagggggaaaacaacatgaagagaaatgtaatagctttagcattatgtacagttttagctattagtgttgtaggatgctcaagtaataatgatggtagcaaaagtttatcaagtgataattcaagaacagtagttgaagatactgaggtattaccaggaacatggtcagaagattatagtagagatgaagtaaaagcattatatgataaagcactagcaagcgttgagtcaacagcaaaaggatattcattagaatatgaagtaactgaaaatgaaataaaagaagaaaatagtgagtcaattaatgatacatatatatatttagatattccagaagcagagagattggaaagtatgtattttggctttaaacaatatgggtctgatttagcaagtggaaaattagaaatgaagatgggttataatttagataaaaaaactatattagaaggacaaaagtttgaatttgaaaacttatctttagcagcattttcacaagcttttacaggggattatgaaagagattatactgaattagacaagcaaatatatgacataattaaaaatgaatctggagatgaaatacaaacaattgaaaataatcttgatggtttaaaagaaacaataactataacagatgatttcttattgtataagttggaaagtagggtatataactttaagtaaataataagctttaattataaatataagtcctatggaggtagaaatggtgaataacaatgaagaaaagctaaacaagggtgaaggccaaagtgatgataaaaatataaatttatcaaatgaaaaattagaagaggctgaagtttatttagctgaagaaaaagtagcagaagctaaagaatttattagagacgaagaaatcaaaaatgatggcaagttattacactatactaaagttatattaagtggagtgttagatcaaatatttgcaatgttattagcaatgcttatatttggaatatttgctttagtgataagattatttgggtataaaattgctatgagagaagaagtgtttttaattacgtatattataagtaacgtattctattatccattaatgcaagaatttttacatggaaaaactttaggaaaaaaatttatcttcagataatatgtgttacacctctatataattatagaggtgtttttcttttagttttaaggtataatattaaaagctagaagttaagagataatattatatttaaatattattggatgacttaataggaacttaaaaaagatgattaaaatataaggattggagtacaagatgaaaagaggaagtcagttaacattaaagataaatagcttagaatttccatcaacaggaatatcagagtgtgaaggaaagaaaatttatgtaaaaggagcttttccagggcaaacagtaaaagcaacagttaagaaaaagagagacgaatatgctgaagcaaaacttgtagaggttattgaaagagctgaatatgaaataccagcaccatgtcctcattttggcgtatgtggaggatgtagttcacaaaacttaacttatgaaaaacaattagagtttttaagtgatgaaatatgtgaactttttgaagctaaggatttaccaatgggaatgtatcttggagtaaaggggagcgaaaattgctgggaatatagaaataagatggagttcacttttggtgatttagaaaaaggtggagagcttactttaggaatgcatatgaaaggtaagtcttttggtgtattaactgttgatagctgtatgatagttgatgaagatttcagaactattcttaaaataactgtagattactttagaaaaactggattaccttattatagagtaatgaaaagagaaggttacttaagacacttagttattagaaaagctactaatactggtgagcttatggttaatttagtaactacaactcaaattgattttgatttaactgaatatactgaattacttaaatctcaaaattataaaggtgaattagtatctgtattacatactgaaaataattctttatcagatgctgttatacctgaaaaggtaaatgtgttatttggaagagattacatagttgaaactttacttggtcttaagtttaagatatctcctttctcattcttccaaactaattctaaaggagctgaatctctttatagtttagttagagactttatgggagatggtgaaaataaagttgtatttgatctttattgtggaacaggtacaattggtcaaatagctgcacctaatgctaaaaaggttgttggacttgaacttattgaagaagctgttgaagctgcaagagaaaatgctaagctaaatggattaaataattgtacatttatagcaggtgatgttgcagaaactattaagaaagttaaggataaaccagatataattatcttagatccaccaagaagcggtgtatctccaaaggcgcttgattatgtaattagatttaatgcaccagagattatatatgtttcttgtaaccctaagactatggttgaaaacttagatgtattattagctcatggatataaagttgataagagtacagttaaggatatgttcccaaatactcctcatgctgagacagttgtaagattaattaagaaatagttatcaaggaaaaaaggccttattattaaggcctttttgtgtttatggaaattattcagttctaagagctgtaacaggatctttcttagcggcttttttagcgggaacaaatccaccaataatagtaagaatcatactaagtataattaatgctattgcgcttactataggtaatgaggcattaatagtatctaaatttaatatagagtgaattatagcattaataggaattaataataatgcagaaattcctacgcctaataatccagaacaaagtccaataataaatgtttcagcattgaatacttgagagatattatgctttgatgctccaatagcacgtaaaataccaatttctttggtacgctccataacagagataaatgtaataattccaatcataattgaagaaacaataagggaaactgcaacaaatgcaattaatacatacgatataacatcaattatagtagtaatagaagataatagtattccaatataatctgtataactaatttgatcttcttcacttgcagttgaattataatcttcaatacaatcagaaatagcctctttattttcaaaactatctgtataaatactaatagatgatggtgcatctaaacttactacaccaaaagtagtcatgttatcatcataagttccagtagaaatatatgcatcataaattttaagaagtgtgtcatcatcaggtgactttaagtattcatctaacatagcagcaagttgcgcttcactcatagttgatatatctggtgttccggattgcattgatgtcgatccttcttcaccttcaacagaaccagtagattgagaatagtacataatagttttaaataaatttgctttatcagaaacaccaagtccttctaagtatttctttgtatctgctaatttttcatcatcactagatggtgagaattccattccatttagcacattaatagttgggctttctttttgagccttaacaatttcactattatctgtatattcaataatataatcggtaagtgcttttgtatatccaattgcgctagtaatagacgtattattatcatcttcttttggacgaacaacacctgtgatctttaattttatagcactgtccattaatttttccatttcatttacatcatcttttattgatgtaaaggtaccattatcatttgcaatataagtatcacagtctggaatcatatataattcttgattaattatatcttcatatttccaacttttactttctaatttaacttcttcaccgttttcaatttttgtaattaattctttatattcagaacttggtaaaatacctaattgataaagtgtagtagcagaaatttcattgttttgatctaatgtaagtataacttcgtcatatgcagtaggccaatcaccatataataggtcataactatccttaatagcattacttactgatataccgtctttaccaggaatcaattcttcaaagttatttgaactagatgaaaatctactgattttagatataggcattgattgcatagcagatattcctatagttgtatttgtagaagtattttcatctgtaagtgtacttccatctgtatttacaaaagttccttctgaatcctttgtatatacaccaaatttagtatcataagaatatataataccattttcacctacatattgatttatttcattatcaggatcatctagatactttttaaattcagttaagttattttcagtaaagctacttgtcatagtagaggccatttcaataccagaattatttgaataaattgcatctaaatcatgatcgacatcactagattttccaggggtaggtcctcctgaagacattatactgttaagatcaatggtttcagcttcaatagatataggatatgatgacatagtctctttttgaatatcatcaatataggtatttacaccgttacttaatgataaaattaaggcaattccaataatgcctatagagcctgcaaatgctgttaaaagtgttcttccctttttagtttttaagttattaaagcttaaagataaggcagttaacaatgacattgaggcttttcccatattttcatgtttaggtggagccaggtttttaatatcaacctcatatgggttagagtcgcttataatatgtccatcttttactttaacaatacgattagcatattcttcagctaattctggattatgggttaccataacaactagtctatctttagcaacctcttttaataaatccataacttggatactagtttcactatcaagtgctcctgttggttcatcagctaataatatttcgggatcatttactaatgctcttgcaatagcaacacgttgcatttggcctccagacatttgattaggtttcttatgaagttgctttccaagtcctactttttctagtgcctctgtcgcgcgtttttttctttctgacttagatatgccagaaatagttaaagctaattcaacatttgaaagaacagtttggtggggtatcaagttatagctttggaatacaaagccaatggtatggtttctataagaatcccaatctctatccttatatttttttgttgaaatgccattaataattaaatcaccactatcataacggtcaaggcctccaataatatttaataaggtggtttttcctgaaccactaggacctaagatagctacgaactcgctatctctaagattcaaagatacttcattaagtgcagtttgtactaaatcgccagtaatatactttttacttattttctgaatttgaagcatttttttgttcactccttactatatatttgaaatagcaatacttgctttggcaatattatgtattttatactacttttataaattgaaagtaaactaatttgtaataaattaaaaaatattatttattttaaaataaaaaagaaaatcacctaatttataggtgattcctggtttttatatttatttgactatttctctattaaaagtattaatattattaattatttcagtaagttcataaggtgattgaggtaagtcattttctagccaagcttcgataattgaagtgcatccacctactgaatatcttataaagtaatctatattagatttaataaattcatttgaattactacatagtttttcaaagtctgctttactagcaacagatagaattcgttctaagattctattatctttttgtttacaaaatagtactttacacaaatctttattttctactattaattcaagaactttaagtaataatgaattagaatattcttcaacaggagtttgatttatatagtcaactattatgttaaatagctcatcttctatagattgaagtagatcaaatgcatccttataatgagtgtaaaaagttcctctatttatatctgcttttttacatatatctgttacagtaatttgatggatctctttgctttgtaataactctattaagctatctctaataacctttttagtatatataatcctacgattaccttttattcctgccatatatattctcctttatattattttttagataatttatatatatatgttatttaataaacaaattagtaaaaaaatgtgtatttaataacgttattaaaatatgtgcttattgcctataagtattaacttccgtatactgtttattgtactattaaacatacaatatgtctatttaatgacatgaagtaaaaagtataatcttaaggaaagtgaaggaaatgtaaaagatggcatatatagacgtacaagatgtatacaaaagatataaaattggtgaaaacacagttgtagcaaacaatggagttaacttttctattgaaaagggagagtttgttgtaattttaggacctagtggagcaggtaaatcaacaatacttaacattttaggcggaatggataattgtgatgaaggaaaaataataattgatggtattgatatatcaaagtttaatgatagagaattaactaaatatagaagatatgatgttggatttgtatttcaattttataatttagtacaaaatttaactgcaagagaaaatttagaacttgctacgcaaatttcaaataatgcattagatatagataaaactttagaattggttgggatttctcatagaaaagataacttcccagcacaattatctggtggagaacagcaaagggtttctatagccagagcaattgctaaaaaccctaaattattactttgtgatgagccaacaggggctcttgattacaatacaggaaaacaagttttaaaaaccttacaagatacatgtagaaaaatgaagacaacagtaatagtgataactcacaattctgcaattgcacaaatggctgatagaattataaaaattaatgatgcaaaagttagaagtatagaattaaatgataatccactttcagttgatgctatcgaatggtagaggtgagatagtatgagaaatagggcatataaaaaatcaataaaaagagaaataatatcttcaaaggcaaggtttttttctatattagtaattatctttttaggtgttgctttttactctggaattaagtcagcagaaccagatatgaaaaaagcaataaataaattttatgatgaacaaaatttaatggatagtaaaattgtatcaacattagggttaactgataaggacttagagatacttaataatgatgataagatattagacttttatggaagtcatactatagatataaatttaactaatataaataatttagtaagattcatggaatatgataatgaaaataatataaataattttgttgttatagaaggtagattaccagaaaatgctggagaaatagcattagatgagagagcgtttagattaaataaaaattttaaaattggtgatgaatatataattgaagctgatgaagatactatggagccatttaatgaaacaaagtttaaaatagtcggtattataagaagtccaatgtatgttgaaaaagactcaagaggggtaacttctgttgggaaaggaacaattgattattttgcagtattaaatagtaaagatatttctatggaggtttatactgaaatttatctaagatttaaaaatgtacaagacttagatgcttatggtgatgagtatgaaaagttaatggaagaaaataataagtatctagaagatttgtttgtaaatagggtattagatagggcagaagaggtaaaatctgaagttgaaaaagaattcgataatccatataaagaaatagaagatcaatatcaacaaattatagctgcagaacagctgggatattccaacgcagagcttaatgaaagcaagcaaaaattattagaagcaaaagaagaagttgagaataaagaaaaagaagcaattgaaagtataggagaaagtaaatattatttctttgatagaactgataaccaaggatacctaggatataaggattctatagaatgtttaggaaatattgcttcagtattacctatgtttttctttttagttgcaatattaatttgcttaacaacaatgacaagaatggtagaagaaaatagattagaaataggtactttaaaggctttaggatataaggacttggaaatatcatggaaatatataatatatgcttcaattgcaagtattttaggtagtgtattaggtatattgataggaagcacagtattaccaagcataattagtaatgcttatgaaagtatatataatgtacctaaaataatactatattattatccagtatatattattcagtctatggctatatcaattttatgcactgttggagctgctttatttgttataaagattgaactaaaaagtaagccagctaacttaatgagagctaaagctcctaaaatagggaaaaagatattattagagagaattacaccattatggaaaagattaagttttaatcataagataactttaagaaatatatttagatataagcaacgtatgataatgactgtattagggattgctggatgtatggctttacttgttacaggctttgggttaaaagattctaatgcaggaatggtagacaaagagtttaataagatatggaaatacgaagccatagtaatattagatgaaaactcaagtgatgaagaatataagaaatataatgatactttaacacaattaaaaggttataaagatagcataaatattcatcaagagtcatttacatttagtaaagagggtatgaataaacaaacagctactttatacgtgccacagaatattgataaatttgatgattttatattattagatgatagagtttcaggtgaaaagtatgatattagtgataatggagttattattactgaaaaattatcaaagcttttggatatatcagttaatgatacaataacattaattgatgaaaataataatagttatgatgttaaagtagataagataactgaaaattatgttgcacattatttatatatgtcaccatcatattatcaaaaaatctttaataaagaacaattatataatgctcaacttataaattttaatgatgataaggaaagtgatgatgaaatttcttctaagcttttagaatgtggaaatgtaagtaatgttactttaaaatcacaaattcaaaagaccactgaagattcaaatgatagtatgaacttggttatgatagtaataatagtagcagcaggttctcttgcatttgtagttttatataatttaaataatataaatgtatcagagcgtataagggagttatcaactattaaggtattaggtttctttaacaaggaagttactatgtatatatcaagagaaaatataatattaacattaattggagttattgtaggatcagcattaggaaagattttgcatacatttataattaatacggcagaaacagatactatgatgatgtatcctaatatttcaatttatacgtatatattttcagcattattaactatattattctcagtaattgttatgattttaatgcatattaagttaaaaagggttaatatgattgatgcattaaaatctaatgaatagataagaatgcttttatattgttaagaagtaagagaggttgctataaataatttatagcaacctcttttaatagttatttttgaatatattatatccattatcattagtttgaataaaataatattggtgagtttttatattttttatgatttaaacaagtgaagagtttaaagggaggagtaaattttttaatcgtttatttcaaaataaatatgaaagtgagtgtttgtataatggatatatttaatcagttttgggtaccaagaggaatatacaagccttgcgggatgtttacagaagggcatatgatattattattaattagtgtatgtgtagtaacttttttattgattgtttcaataaaaataaccgtagaaaaaattgatatattaacaaaattatttgcagttattttaacatgcttagaaggaataaagatattttttaatttttattggggatatacaaaggttaattattggtttccgatatcattttgctcaatatttatttatgctttatggatgagtggatttactagtgggtatttaaagaagataggggattcatttattacaggagtaacagtagttgcaggaggtgcatatttattatttccatctacttcgttaactgtatatccaataggacattatttatgtatttatagtatgttatttcatacattaatgatttatatgggagtagtatatttaagaaaaaaacaaataagtctaaattggaatacatttaaaaagtttgttgtgatttatttattttttgctgtaatttctatttttattaataatataagtggaagcaatttaatgatgttatcttcaccagctaatattccattaaggtttcttcatactttatatggaatcaatgaatgggcgtatacagggtttgtattcatagtatatttatttgtaccgtattggggaacttcatatacattaaaaataataaaaaaagcaacaacaagaaaaatagagaagaatttaaagggtataatttagaagtataaaatagataaaataaatatagtaggaatgaactgctccctgtcaagtagacagggtaaataataaaaaattatgctactaaggtgtggctcctatattcaaatggagccatgccttttaattttttttgtaatcttttgatattgtaaaattctatatattcattaatatcttgttcaagttcttcataggtatcgaacttttttaatttgaagtatgaaggtgttatttataagaaaaattaaggtcctaaaaataaggtgggcttaagattactatttgctccagatgtggtacaaggtctagataaaagattttaattgtataataaagaaactatattactgatatgaacatcatccagaatatagacggggtaaataataaaacaaaattacatatgagttagaagaaggaatggttaaaaggtatttcttctttttttatttaaaaatattagacaatacaagtaaaggtttaaatgacaaaaaatacaaaaatattatgaaaatttcagaggaaatttatcaagaaaatgattaatttgatgagtaatgtaaaaatatattatttgacatagagtgcactctaccacttataatgaagttataggagggataaaatggaatatttgattaaagatgcatcgaaaaaacttaatatttcaatatatactcttagatattatgataaagaaggattaacgccatttgtaaaaaaggatgaaaatggggtaagaaaatacgctgaagaagatttagaatggataagaatgttaataaatcttagagatattgatatgcctatttcaaatataaaagaatatattcaattatatctacaaggtgataaaactatagatgaacgtagagatttaatatgtaggtatacagaatatataaaaaagaaaattgaaaatacaataaataatttagaaatggcaacggaaaaattaaagcgatatgattctgcggtagcagatatattggatgataaagagttatttgagtttaataaaaaataatataagtaaattttggccaaagtttcactaattgagaggtgtaatttgataaagaaattattaattggtggagtagtatgttttacagtaggagaagttgcaatagcttcatatttactaaaaagaactttagtaagaggaagagctaatgttgaaagaacaaaaaagatgtcaggaactaactgggttaagtatattcctgaaattaaaaagaggaaggattggcttattaatcaagaacataaagacgtttatgtaaagtcaaatgatgacttaaagttacatggtatattatttcctaaaaataattcgaaaaaaatagtcatttgtttacatggatattcaagtaatgcgggaataagtgaccatgctgctatatcaaaattttatttagatatgaattttaatattttaatgatagatgctagggctcatggaagaagtgaaggaaagtatattggctttggatgtttggatagatatgatttattatgttggataagctatattatagaaagatttggtgatgactgtgaaatactattacatggtatttcaatgggtggagctacagtattaatggcaagcggacttgatattcctaataatgtaaaggggattatatctgattgcgcatttacttcagcttgggaagtatttgttgatgttttaaaggatatgtaccatataccaccgtatccaataattaatatagcaaatagtattagtaaaagtattgctggatatggattaaatgaatgtaattcagcagaagaagtaaagaaagcaaagattccgatattatttatacatggtgatagtgatacctttgttccatgtagtatgagtaaagaaatatataaaaattgtgcttcgccaaaggcattacttatagttaaagatgcaggacatgctgagtcttactataaagatacaataaattatgaaaaaaaggttaaagattttatagaaagatacttatcaaataaggaagtgattattaatgattaacgaaataacagagaaaaaattatatccattaacatatgcacaaaagctacatttttttacattgaaatattgtcctaagaaacaagtattgaatataggtacaagcttaactataaaagaagatattaactttgatattttaaaggaatctatatatgaagcgtattcaagatgtgaatctatgaggcttagatttgttagtgattcagaaggaaatgtatttcaatatgtagcagataaggaagaacgagatattgaattttttgatttttcatcatggaggatggaggatgctgaagctaaaatgcgagagtggacagaaactccatttgatagagaagataagccattaaatagaatagtaatgattattactccagataattataagggaatatatttattagtagatcacatgactatggatgctcagagtctaatagtttttatgaaggatataattgaaatttattgccataaaagatatgaaggtatggaatatcccaaaaatatgacctcatatataaaacaattagaaaaagatttagaatatgaggcagattctaagtttaaggaaagagatagagtattttttgaaaagttaattgaaatgtcggaaccgatttacaatgatattaatggaatagaaagattattagaagaaagacataagcgtggtgatgacagtgtaagaaatgttactaacgtaagtgataatgtagatgctaatattacagtatttagtttagaagcagaaccatcacagagattattagagttttgtgagaataataaagtaccgatggtttgtttattaatgatgggtcttagaacctatcttcagaaatttaactatcaagatgatgtttcaataatgagtacagtagcaagaagagctacaatatcagaaaagaaaagtggtggaacaagagtacattgttttccttgtagaacaattgttaataaagaagaaacatttatgcaaggtatcgaaaaaataagagaagcacaaaacaacttgtttagacatgctaattatgatcctgttgagtacttaaatcatagaacaagcttttataataatgaaccaggtcaaacttatgagccacttagtttaacatatcagcctttaacaatgaaagatgtaaaacaaagaaatggacaaactatagattttagtggtattgattataaaaccaattggtattcaaatggagcttgtgcacatactctctatttaacagtaatgcatagatcaaatgataatggattgaactttagctttgaatataaaaccggaagagttacccatgaaaaattagagtatatgtattattatatatgtaagattttatttgaaggaattaaaaatccttataagagtattggtgaaataattgaaagtgtataagtgtggaggttattatgatatttaataaagttaaagatatattaagtgaatatatagatatagatagtaatgaaattaagttagaaacaagattagctgaagatttgggattaaattcttatgaatttatgagtgttataggagaaatagaagatgaatttgatttagagctagaagaaaaggaaattcctaaacttatttcaatagcagatttactagattatataagtaattatactgaagaaaatgtacttgtataaggtagttaatttagataaaaatttttcaaaggcacaaaaaaataaagaacttcataaagctgcatttaatttattagaaaaaaatttaataaaagagtttcattttaagaaagaggacctgaagtatatgattggtttaaaaggaaagccatatttaaaaaagggttctcctttttttagtatcagtcattgtgataatattgttgtttgtattataagcaaatgcaatgtagggattgatattgaaggtgttaaagaagttaataaatttatagtaaataaagcattaacacaaaaagaaaaacttcagttagattctttaaagagcaataaggatgaatatttctttagaatatggactttgaaggaagcattattaaaaaatataggtgatggattatcatatggtattaaaaacattgaatttgatattaaagatgatattacttgcaacttaaaagggtttaaatttaaacaagaaaaggtaagtatagaggataaagaatatataatatctatagcgtgggagggtattaatgaacaatattaaaaatatgaaagatataattgattatgcagcaaataattatggggatagtgtagcatttaaatataaaattagtaaaaaagagattgaaactagaagttatagggatttaaaagaggatagtgaaactgtaagtaatgcattaaagtctttaaatatgttaggaaaacatgtggcgataataggtcctacatcttatgcatggattataagttactttggggttgtgaattctggtggggtgattgttccaatagatgataaactatctttaaatgatgtatgtgaacttatagaaaggtctgattcagaggttttaatatatgataataatagaatagatgtagctaaagcagttaaggaaaaatgtcctaaaataaaacatataatttcaatgacagagaggcttaataatgaatttactttatcattaaatgaaataatgggggataataggggtccattttcaataaaaattgatagtgaaaaactttgtacaatattatttacatcaggtactacaggaaaaagtaagggtgtaatgcttaatcatagaaatctttctgataatgcaacagtttgtgatatgcaacttaaaccaggaacagtatcaatgacagtattacctattaatcatgttttttgttttaccatggatatattaaaggggatatattgtggactttgtatatgtataaatgattcgatgataagattttctaaaaatttaagtttatttaaaccagaagtaatatgtcttgtgcctatggtaatagaaggcttgtataataaacttatggattctagtgtgatgttacctaaaaagcttattgcagaggcagctttaggaggaaaactaaaaactatttatagtggtggtgcatatttaaatccaaagtacattgaaggtttcaaagaatttggaatagaggtaatacaaggatatggtatgaccgaatgttctcctgtaataagtactaatctacctggaaaggtaaaaaaagaatctgtaggacaacttgtagcaaactgtgaagctatagttgtagatgaagaaatatacgtaaaaggttcaagtgttatgatgggatattataaaatgcctgaagagacaaaagaaacattagttaatggatatcttaaaacaggagatttaggttatatagatgaagataattatctttatataactggaaggagaaaaaatcttataattttagctaatggtgaaaatgtatcacctgaagaattagaaaatggacttttagagaatagaatggttaaagaaattgtagttagtgaagataaagacgtaattaaagcagaggtatttccagattatgattatttagaaaaaaagaaagtgaaaaatgttcaagaggaaattcaaagtattgttgataaatataatagagagttaccaagctataaaagaattaataaagtatatataagaaaagatgagtttgaaaagacagcatctcaaaaaattaaaagacaatatgtgaaaaaataataaattagaagtaagctagatgattaatcatctagctatttttataaaatagtgcaaatgattataaatatttaacgaaatttaaaattattttttatatattgagtttatagcatttactttgaaaaatgctaactatataattatgatgataattaataaagtatatttataatatattttagtaattaggtaaattataattatataaactaaaaagattgggggaataggcatgaaatcattaaagattgcttgtaccgaaagaactagaaattacttttttacagatagagagaccatagaagttggaacaactgattatacagatgtagcagctgctgtagtaaatgaaagtgatatagaaggtataaatgatatatatgatacaaggtttgggatagaaatatttgtattagcggaaacagatgaaattgatgatgaaattaaaaataaagtacataaaataatacatattaatgaattaaatgaagaagaatttagtgaaaaattgaataaagctgcagataaatatgaagaggaaatgttaccaccattttttgatgttttaagtgaatattcaagaagaggaaatttacagtttgcatgtccggggcatcaaggtggtcagtattttatgaagcatcctgctggaagagctatgtatgaattctttggtgaaaatatatttaaatcagatatatgtaatgccgatgttgatttaggtgatctattaatacatgagggaccagctatgtcagctcaaacttatgctgctaaggtatataatgcagataagacttattttgtaatgaatggaacaagtacatctaactcagtagttataaatgcaatagtttctccaggagatttagttttatttgatagaaataaccataaatctatatataattcagcattagtttcaagtgctggaaagcctgtatatttagaaacatcacgtaatccatttggatttatagggggaatagatgctcattgttttgatgaaaaatacttaagagagcaagctgctaaggttgatagtaaaaaatctaaggaaaaaaggccatttagattagcagttatacaacttggaacttatgacgggactatatataatgcaagacaagttgttgataaaataggtcatctttgtgactatatattatttgattctgcttgggttggatatgaacaatttataccaatgatgagggactgttcaccgttattattagatttaaagccagaggatccaggaatattagttacacaatctattcataagcaacaagcaggattttcacaaacatctcaaattcataaaaaagatagtcatcttagggggcaaaagcgttatgtagatcataaaagatttaataatgcttatatgttatatgcatcaacaagtccattttacccattatttgcagcattagatgttaatgcaagaatgcaggatggggaagctggtaagaagctttgggcagactgtataaaggttggcgttgaagcaagaaaagacgtattagaaagatgcgaattactaaagccatttataccacctgtagttaatggaaagccatggcaggattatcctacagaagaaatagcaaataatataaagttctttaaattccatccaggagaaaagtggcattcttttgaaggatatggagaaaatcaatattttgtagatcctaataaatttatgttaacaactccaggaatagatgtagaaactggtcagtatgaagagtttggaattccagcaacaatacttgctaattacttaagagaccatagagttgtacctgaaaaaaatgatttaaattcaatattatttttattaacaccagcagagagtacttcaaaaatgaaggggcttgtagatcacttggtaagatttgaaaatcttataaaagaggatgcaccattaaatgaagttttaccaaagctttatgctaaatatgaagagcgttataagggatatacaataagaagattatgtcaagaaatgcatgatttctataagaaaaatgatgcaaagacttatcaaaaattattatttagaagagattatttaccagaatacgtaatgaatccaaatgaggcaaatatcgaactaaaaagaaataatgctaaattagttccattaagtgatatagtaggagaaatagcgttagagggagctcttccttatccaccaggagtattttgtgtagttccaggtgaaagatggaataatgttgctcaaaaatatttttcaattctagaagaaggaattaatagattcccagggtttgctccagaaattcaaggggtttatcttgaaaaagaggatggaaaagtaagagcatatggatacgttttagataaataatatttttaatataacaacttccgggggacaggtatgaagaggaaattttacaagttagtaaaagaaaatttattgagtaaaaaggacttatttatatttacaattttagaatcagttaatgatttagatataggtaagaagatattaaaagttgataatgaatttatatttgaagatgaaagagatagagagaaatataaagaaatcattgagaatttagagttaaaagagactaataaaatatttgatattaataattcttataaaataatgttagaacaaattgtatctaaacctaaattagttatttgtggtggtggacatatatctttagaattatataaggttgcaaaaatgttagattttaatgttattgtaatagatgatagagaagagtttgcaaataatgaaagatttccattagcagataaggtaatatgtaagaattttaatgaagcacttaaagagataagttatgataataattcttattttgtagttgtgacaagaggccatagcgcagatcaaatgtgtattgaggcagttttaaataaagaatataaatatttaggaatgataggtagtaaggcaaaggtagctaattcaataagacaattagttgaaaaaggatatagttcagaagatattgaagaaattcatgcacctattggattaaatataggagctcaaacaccagctgaaattgcaataagcatagccgcacaaattatagaaataaagaataaaagtaacttatcaaatgtagatgaaaaaatattaaatgccatcaatgaaaataatagaaaaatggttttagtaagtattttagataaagtaggttcatctcctagaggagtgggtgcaaaaatgcttgttacagatgataagaagtttattggaaccattggtggtggaagtgtagaaaatgcagcatatgaaagagctttagagttaataaaagaagaaaaatcacatattgagtgttatgatttatctaattcagtagcagcaaagttgggaatggcttgtggaggaacaataaaggttcttttggagtatataaagtaaaaaacgaaaaatagtgatttaaataaaatattttctaaaaaacaaaaggcaaactatatttaatagtttgtcttttaatttttgtgttttcggcagttgtttatacttttttcacctaaaaaattcaaaaaaagataaaaataaataaaattttatacacaaattagaaaaagtatgataaaatcatgaagtgagtttaacgtacattaagcagattaaaattgaaaaatattcgcaatttatattaatacttatagggggatttaggatgaaaacaggaagtatttatcaattagaaggaaaagtacctttaaaacaagctattccattagggattcaacatgtattagcaatgttcttaggaaatgtatcaccgcttattatagtatgtggtcttttagatattcctttagaaacaaaatcaatgttaattcaaaattcaatgtttgttgctgggattgcaacattaattcaattatatccattctttaaagtaggaagtggactacctgtagttatgggaacaagttcaggatttataggaactcaaaatgctataggtgcaacttatggatattcggcaataatgggagcttcattagttggagcaatcttagaaatagttttaggattcttcattaaaccattaagaaaattatttccacctatagtaacaagtttagttgttatttcaataggactttcattacttccagtaggtattaaatattttgctggtggagctggttcagctgactttggttcaccaaaacatttaatagttggaacagtagtaattttagtaataataatattacaaaattttactaaaggatttataaaaacatccgctattttaatagggataatagttggatacatattagcaatagtaatgggaatggttgattttacagctgtaaaagaagctgcatggataagtttaccgagaccatttgctatgggatttgaatttagattagatgcaataatttcaatggcaataatgtatattgcaactacggtagaaacgattggagatatttctgcaatagcggtaggtggacttgatagagaagcaactgataaagaattatctggtggtgtagttgctgatggggtttcaagttttatagcagctatttttggggttgcaccaaatacttcatttagtcagaatgttggacttgttgcggtaactaaagttgtaaataaatttgttataatgactggggctgtatttttaatattagctggattcttcccaaaattgagtgcagtactttcggtaatgccacaatcagttctaggaggagcagcggttataatgtttgctatgatatttgtaagtggtttacaatcgctatttagagaaaagttagatggtagaaatggtttaatagttgcattagcaataggcataggtgttggaataggtaatgttccagaagctttagcacaattaccaacttgggttagtaacatatttgcacaaaatggtataataatgacattcgttatagcaacaatattaaatttagtattaccaaaagataaggtagaaaataaagcagtaagtgtataaaaaatataaaaaaagggcttatatcgaataatttgatatggcccatttattgtgtctataggaggagaaaaaaattgtttacgattaggaattatgtagtagcaaaaagcttagaagaagcttatgagctaaatcaaaaaagaaacaatgttattttaggtggaataggttggcttaaaatgggggggagaaatatccaaactgccattgatttatcagaattaggattagaccaaatagaagaagatgaagaaagttttaaaataggatgtatgtgtacattaaggcagttagaaactaatgaagctttaaattcttattttgatggaatcattgcaaaatcattaatacatatagtaggggttcaatttaggaattgtgcaactataggtgggagtatttactcgcgttttggattttctgatatcttaacatcattattatcattagaaacatatgttgagttatttaatggaggtattatttcattagctgaatatagagatatgccttatgataatgatattttagtaagagtaataataaagaaggataatagaagaacatcttatttaactcatagaaatagtgcaacagatattccaactttagcagtagcagtttctagattagaaaatagatggaatattgtaattggagcaagaccacaaaaggctatgattgttaatgcagcagagcttttaagtgaagttccaacacaaaaagaaattaatgatgtagttaattatattatggaaaatgttaaatttgatagtaacatgagaggtagtaaagagtatagacaaatacttgcaaaagtatttataaatagagcaataagtgaaattacaggaggaagctatggaaattaaactatggataaacaataaactttttcaagataatgtagaagcagatatgttactaattgattatgtaagaagcaaaggtttttttagtgtaaaaagagggtgtgaaactgcaaattgtggtttatgtactgtgcatttagatggaaagccagttttatcatgtagtactcttgtaatgaaagctaatggtaagaaagtaactacacttgaaggtttaaaggaagaagcagaagaatttggtagttttatggctgatcaaggtgcagagcaatgtggattttgtagtccaggttttgtaatgaacgtattagctatgaaaaaagaattagttaatcctacagaagaagagattaaacattatttagcaggaaatctttgtagatgtacaggctacatgagtcaattaagagcaataaaaaattacctagaagctaaaaaggaggactaaaaatgaaatacgttaataaaggtataagaaagaaggatgctatggcattattaactggtaaacctgtttatacagatgatatagctccaagcaattgcttaatagtaaaagttcttagaagtcctcatgcacatgccttgatagaagatattaataccactattgcaagtaaagtgccaggaatagagtgtattttaacttataaggatgtaccacaaaagaggtttacgacagcaggacaatcatatccagagccaagtccatatgatagattaattttagataagaggcttagatgtgtaggtgatccagttgctatagtcgctggggaaaatgaaaaagcagtaaataaggcattaaatttaattaaggttaaatatgaagttttagaagcagttttagattttagagaagctttagataataaagttgtagttcatccagaagaagacttttttgctctaaatgattggattaatgtggataaaaatagaaatatatgctcaaagggtgagtttatccatggtgatgttgaagaagaattaagtaaatgtgctcatataatagaacaaacttatcatactaaagctaatagccaagctatgatggaaactttcagggcatttacagaacttgatacatatggaagattaaatataacaagtgcaactcaagttccttttcatgtaagacgtatattatcaaatgcattagatattccaaagtctaaaataagagtaattaagccgagaataggtggaggatttggtgcaaagcaaagtgttgttgctgaaatattcccagcgatagttacaatgaaaactggaaagccagcaaagatagtttatacaagagaagaaagcatgactaatggtagtccaagacatgaaatggagataaaagttagattaggagcagatgaaaatggtataataaaggccatttatatgtatactttatctaatgcaggagcgtatggtgatcatggaccaactactgtaggattatcaggtcataaatcaatgcctctttataatggagcaaaggcttataaatttgaatatgatgttgtttattcaaatactatgggagctggtgcttatagagggtatggtgctactcaaggattatttgctttagagtcagctgtaaatgaacttgcagataagcttaatatagatcctattaagctgagagaaatgaatatggttgctgaagggcaaataatgcctgcatattataatgaagctgcaaatagttgtgcattagatagatgcttatcaagagctaaagaaatgatagattgggataataaatatccttgtagagatatgggaaatggcaaggttagatctgttggggtcgctatggctatgcaaggttcagggatatcgtcagtagatactgcggctgttgaaataaagcttaatgatgatggattctatacattaatgattggtgcagccgatatgggaacaggatgtgatacaatattagctcaaatggcagctgattgcttagaatgtgatatagataatataattgtacatggtgttgatacagaccaaagtccatatgatactgggtcttatgcatctagtactacatatataacaggtggagctgttattaaaacttgtgaaaagatgagaaagaggattattgaagaagcatcaaaggcgcttggatgctcaattgataatttagagtttgatgggaaaaaagtattttcactagtagatgaaaaggaaataagcttaattgatatagcaaataatactttagttggcggatttaatactataagtgaaagtgaatcacattattcagaagtttcacctcctccattcatggttggaatagttgaaactgaagtagataagctaacaggaaaagttgatataattgattatgtagcagtagttgattgtggaactgttgtaaatcctaatttagctaggattcaagcagagggaggaatagcccaagggataggtatggcgctttatgaggatattacttacactgaaaaaggtaagatgagaaatgattcattccttcaatataaaatacctacaagactagatgttggaaacattagagttgaatttgaatcaagttatgaacaaacagggccatttggggctaaatctattggagagatagttattaatacaccatctccagctttagcacatgccgtatacaatgcaacaaaagttaatataagaacactaccaataacatctgaaaaaatagttatgggaatgattaataaatagtttggagttaagagttaatagttgaggatgaaactcatattggagtttctaaaatatgcattttagaatttagcttaagctgaatttatcttaaaactattaactcaaaactattaactaaattaaaggttggttttatgaagataaatttaattttattggcagctggtaatagtaggagatttaatgggaataagttgcttgctttatataaggataaacctatttacatgcatgtagtcgaaaaatcccttaatcttgaggttaataaaataatatgtgtaactcaatatgaggaaataagaaaaaaattaaaaaacactaagattaatgttgtaatgaatgataatagtgacttaggaatttctagttcgataaagctaggggtaagttttgataaaaatgctgatggatatatgtttatggtatgtgatcagccttttatatccttaaaaacattaaatttagttaaagatacatttattaatggtgataaaggtatagtttgtgtaggaagtggaaataataaaggtaatccagttatcttttctaaaaagtatattaatgaattattatcactagaaggggatattggtggtaaaaaaataataaaggggcacttagaagattttgaaattgtaaatattagtaatgaaattgagctatttgatatagacactaaggaagaatatagtaaaatttctttatgaaaatatttacattaaaatattttaagttttttataaaaactttttaaaatagtgttgacttttgtctaaaaacactgtaatatacaaaaagtagtcagcagtacatgttgatttggccccttggtcaagcggtcaagacaccaccctttcacggtggtaacaggggttcgattcccctaggggtcaccattatgcgggtatcgtatatcggtaatactccagccttccaagctggaaaggtgggttcgattcccactacccgctccattttcagttttaaagttttataaattaatgttaacaatgatttgtaatttaccccagcacaaagaaatttttataggagcatggggaactttagaagataaagaaagtagtataaataaattattataatatagcggtgttataagtttatagaaatatagatttatagcaccgcattttttttattttaatttaattttgatattttcttttctaatctatcaatacgctttttgctatcatcattccaaccctctgaaaaagcttgttgagttatttttaaagcatttaataattctccttttttttcatatataattgctaattgcttatatcctacatgattaggtaaaaattcttgtttagcaatataaacttctttaactttagatgatatattaatttgttttttgcagtattcaatagatttatctaatgccccatctattttatctctattactataatataattttattccatgatgatatgtaaagtgaacatttaaaatatcgtcttcatcatttattatgctttcagctttttttaatattttttctccaatataaaaattttcataagatgtaaaagcgccaattaaaaagcaaagaaaatgtagtttgctcgctgatgatttataaatttcacctttatcaataacaaaatcatcaccagcaccaaaaggtttataaatttctctaattatagttctttcttcttcagagaaatcatttgaccaccattcttcaagattataatatgctatatctccaccaattttattagatttaaatttattaaatatattaaaaatcatttcttaatactccttaaatatttttataaatattattatatatgcaaattaactacgaataaacaaaatatattttttagtataccaactttactaaacgaagctattcgttcagtagagtattttattaaaagtgaaaattttaaactatagaatttattataataaaacctaaaataaaattgatattttattatagcagttttggaaaacgccaatttggcggtatcaaaatatttaatattaattatttaatataaatacaaaaggtataaattacatattttcatgaatgaacttattcaaatcttaattataaaatataaatataaggcatttttaagggggtgcaaaataattcgattgggtttgctcctaaaacccaaagagccaattaaataattggtgttttaattaaaaaggagatagtttgaaatgaaaattgatattgtggaaaatgatgggttaatcaaaatttataattgcggtgttttaatattagaggaaagtagttataatgaaatagtattaactataaaagaagcattaaccaccattaatgatttatatcaaatagaagttttaaaagaaattctaaagtatataaaacataatgaaatggcggtggcttaatatgaataataatatagcttgttatataagggtttcaagtgataagcaagaccagttaaagagtttaaatcaacaaagggaactattacaaaaaacatatgaggaaaatgaaatattaatgtatagtgatgttggaactggtacaagctttaaaagaaaaggctttaaggaacttttatatgatgcaggattaaatgaaaaaatattaaaagataacagattaacgtttgaagtagatgaatatagggaacctttatttaatgaaataatagtgttaaatacatcaagatttgctagaaatattgcaattatagatatattaagagttttatgggattataagaaagttaatgttaaatttttagatgttcagaaggatagtaataatccaagtgatatgatattattacaaatgttttttgctatggcagaaaatgaagttgctgaaacttctaaaagaactaaaagaggtaataaaactactataatgcaaaataaaataagaaataatagtatttttggttgggattttgataaggaaacaaattcattaatagcaaatccagaagaagcaaaagcagtaaaatttatttttgaaacttctttagaatatggattaaaaaggactgcacaaattgtaaatgaagctggatatagaactaagaaaggtaatttgtggagtgatagcactataagaacattagtcgctaatcctaaatataaaggttttaatgttagaaataaatttagcagcgaaaatttgtttacagaaagcaaagttaaatatgttagaaaagaaaattgggttgttatggagaatgaaagaattgaacctttaataagtattgaattatgggaagcagtacaaaaggcacaagctgaaagatgtctacatggtaataaaggaactaattcaagaaaatacgatactaggggtaaagtagtatgtaagtgttgtggtggtacttatataagagcagttgaaaaaagaattattgataaaccacaagggaaacactatttgatttgttccaagaaaaaaaagtatactaaaaaatattgtcaatccgaaaacatcaatgttgaaacgttagataattttattgaagagcaaagaagggtatattataaaaatatacaattgcagattaatttaaagatgattaaattaaagaaagaattatcaaaagtaaattctgaaaatgtagatatggttaatgatttaataaaggttgaaaatgataaattagatacatgtaaaaaatcattagaaacacttatagacagttttgtaagtacaacaagtaaaactatgcaagatattattaaagctaaaatagaaggtattgaagcggagataattacaatagaaaataatattgtatctttagaagttaaaaagaatgataaagataaatatattagagaattaaataataaaataattgcacttaaaaaagaaggacaacaaataccagggaaagaattaactagaactgaatggttagataaggttgataaaattgttgttggtggtaaaaatgatttagttgcagcatataaattagactaaatttttttagcttcatatacttcttaaaggtgtgaaagagggactactaaagttgtatagtatatttatagtaagagttagtgtaaaagctagctcttttttatttatagataaacttaaaatataatgtatattgctagtaatgaatataaattaatacaattaagaacataatttatttaaaaagagtataatataaaaaacttatatgggggataactatgataagtagacaagaatatattacatcatcattagaattgcatcttttttttggacgaattatgaaagaacattcattatttttagaggctggatttacacctaaaaatacaaaactttctaaagaggcagaacattataagattgcttttgaaaaacttttattagacacagttaaattgagtaatggaaggattagagattcggtaatcgattcgggtgaaatttttactgagtatacattagaaactgagaaaaagacaaagtattatacaggaatagatattaatcataacataacactgatggaagaaaagttagagtgtaaaactacaaatagtattgacggtaaaatagcaaacaatataagacagcttaatgctagagccataaaattagtagatgggctaatagatcttaaaatgagaattttagatggaatgttatgttgtaagctatttacagtaaactatccattacttatagaacatataatacgagaagcaaaattatatcgttcatatataaaagaacttgaattagataataatataaataaagggaatactaagaaaattgagttgttttgggatcaaattatgatggagcattctttatttattagaggcttacttgatccaagtgaagatgaattaataagtacttcaaataaatttgcaaatgagtttagtgaattaattcaaaaagctgataattctactgagatgacgatgcatagcattacaagtgatacattaatggaaactattaaattaagagattttaagaaagcgggcgcaaaggggatagttgactgcaagataaaatctataatattgccattgcttgctgaccatgtattaagagaagcaaatcattatatacgattattaaatgagtgcaaaggtgtataaggatagtaatatttaaagattagtagaaaattaaggtagtgtaatatttatgttatagggctagtgaaagctagccttttttttatgagtttttctataaaatttatatttttatcttctttatctcttttttttggaaacattatgacatatttcagcgctataattctatgttaacgtaaacagttataaactataatttatatgtatttaggaaagcgctttcttaaaacaacaatatgtttatgattacttattttaattaaaaaacaatgatatgaaggtaaaaaagttatatagaggttaaaataatgtttttttaaaaaagaagaagtatggaaataaggaggaattttaaatgacacgacttggaatttctatatatccagaacattcaataaaggaaaaggatattgaatacattcgtttggctggtaaatatgggtttaagagagtatttacatgtttattaagtataggtaaaaaaacaaaatcagaattaatagcagaatttaaggagctaattgatgttgcgcatgaagagggaatggaagtaatacttgatgttaatccaagggtatttaaagatttaaatgtatcttatgatgatttatctttatttagcgagatcaatgcagatggaatacgcttagatgaaggctttgatgggttaaaagaaagtcttatgacatataacgaaggtggattaaaaatagagttaaatgcaagttcagggagtggttacttagataatgtaatgagcaattttccaaacaaggataaaattataacttgtcataatttttacccacaaagatatacagggctaagtttagaacactttaataattgtaataaagcaatgaaagattatgggcttcatacagcagcctttgtatcaagcaataacattgatacttttggaccttggccagtaaaggaaggtctatgtacattagaaatgcatcgtgatttacctatagatttacaagtaagacatctatttgctactaggatgattgatgatgttatgataggaaatgcttatgcttcagaaaaagaattaaaggaatgtgcaaatattaatccaggtattttaacattcggaattgagttagataaagaattaacttcagtggagtatggaattttatattataagcaaaatcacgctaatagaggatatgttagtgaatatatggctcgttctagtgctccaagagtaacatttgctagtgaaagtattccaaaagcaaatgccgttgatatgaaaagaggagacgttgttatattaaatgatgaatattcaagatataaaggtgagcttcatattgtattgaaagatatgcctaatgatgggagaaaaaatgtaattgggcatatacctaaggaagaattatttttacttgattatatggaaccaagaaaaatatttactttcaagaagagtttataaatattaatagatatatgaaagagagtgagagaattatatgaaaagaatatatttattttgtagtgcaggaatgtcaacaagtatgttagctaatattatgcaaaatgttgctgattcacataagcttccattagaagttaaggctttttctgatagtaaaatagatgaaatagttgaagaaaaaaatccagatgtaattttactaggtcctcaagtgaaatatagatacaaagaaattgtaagtcgttatgaaaataaggggattccaattgaagtaattaattcagatgattacggaatgatgaatggagaaaaaatactgaaacatgcgataaaacttataaaaaacaataaatagaaggtgaggaagttattaatgatgaataaactggaggcaatttttatacctcttgccgaaaaaatagggaaaaataaatatttaacttctattagggatggttttttacttacaacaccattattaattataggatcatttttcttacttattgcaaattttccaattaaaaattggacagagttctgggcgagattttttggggaaaactggacagcttatatggcaaagccaacaaatgcaacattcgatattatggctattttagcagtagtaggaattgcatattctttttcaagagaattaaaggtagataaattatcaggagctgctgttgcattagtatcttggtttatattaatgccatataaagtttcagatggtagtacaactttatcaggaattccattagattggattggatctaaaggaatatttataggaataataactgcatttgtatcagttcatatatatgcatgggtaattaaaaaagggtgggtaattaaaatgcctaagggggttccaccagcagttactcaatcatttgcagccttaattccttcagcagtagtgttaggtgtattctttttaattaatagtttattagcacttacaccatatggcaatgcttttgagtttatatttagatttttacaacaaccacttttagtgttagggaatacattaggtgcagtattagttgcaatgggattccaacatttcttctggttctttggaataaatggaggatctattgttggtagtataatgcagccaatattaactcctctttcaattgaaaatttagcagcttttcaagcgggagctactctgccaaatgtaataaatcaacaattttatgatttatttactacattcggaggagcaggatcaacgttatctatgttaattgcaatgattattgtttgtaaatcaaaacgtattaaaaatttaagtaagatttcagttatacctgctttatttggaataaatgaacctgttatatttggattacctatagtattaaatccaacaattttaattccgtttttattaacaccacttataaatattttaatatcatatttttcaatggttagtggtttagttccatttactagtggaataagtatgccgtggacaactccagttattatatcaggatttttaacaactggctggaggggagctgttcttcaattaattcttgtaatattaggtatatttatctatatgccatttgtaagaatgatggacaagcaatatcaaaatgacgaactaaaggaaaatgataattcggatgatgatatttcacttgatgatttatcatttgatgatctataggaggaatgaatagtatggaaaatttagaaatgctttgtttacagattatttctaatgtaggattagcaagatcaagttatattgaagcaattagtaaagcaagagaagaagattttcaaggggcagaagaatctatgataagtggtaaggaacaatttttaaaaggacatgaacttcatttagagctctttaagaaagaaggaagtaatatgtctataaatacatcagttttattaatgcatgcagaggatcagctcatgagtgcagaaggatttaagattatagctgaagaactaatagaaagttataaaagaattaacaatcttgagaaaaaaataaaaggtgtaaattaattatgaaagttataatgatattagatcaagtacaatctgggtatggaacaaaaaatgataagatggttccactcacaggcactaaggaaataataggcccggcagtaattatgaaaccttatttaagtgaaataggtgctaatatagttgcaacactttattgcggagctggaacttatcttgaaaatcccaatgaggttagtcgtaaattttgtgctatgattaataagttaaagccagactttgtaatatgtggaccatcagtaagttatgcagaatctgcctctatgtgcgcgaaggtagcttatgatattataacaacaactaatacgaaagctttagcggcagtttcaatagataatgctgaaataatagaaatgtacaaagataaagttgtaattgttaagacaccaagaaaaggtcagggtggattaagcgattcactaaagaatatatgtacagttgctaaaagattagtagattgtgtagaactagatgatattaagaataaagtttgcttttaaacatgtaaatattaaaaatagctaaaaagaaaaaatactaggttaaaacctagtatttttttcggacttctaagaaagtgtcatatattttgattcagattatataaatatataatacatttataataacaattaaatattttaagaataccctataataagtattaaatttaatggagtataaaaatgggctattatgttaaggttgaatcaaatgttaaagtatatgtagaagatcttaatgaaaaggctgataaggctattgtttttttacatggatggccaggaagtcatgaattgtttgaatatcaatatgattatttagttgagaaaggttatagatgtattggaatagatcaaagagggtttggaaaatctgataggcctgtgtgtggatatgattatgatacattaagtgatgatgtaaaggcagtggtggatgtattatgcttagataattttatattactaggtcattcaacaggaggtgctatagccataaggtatatggcaagaaataatggtaaaggagtagataaactaattctttgtggagcagcagctccaagccttattaaacgttcatatttcccatatggaataagtagagaagttgttgaagaaataatagaaggaacatatagtgacaggcctaagatgttaaaaaagtttggagagatatttttttataaaaaagttagcaaaccccttatggaatggttctttcaattagggttacaagctgctggttggtcaacagcaaaggttgctaatacttggttagatgaagaagaattatttgatgatatgaaaaagatagatattgaaacattaattttgcatggtatacatgataaagtttgtttatttcctttggctttggagcaaaaaaaattaataaagaacagtaaattagtgaaattcatgaatagtggacatgctacattttatgatgagagacagaaatttaatcaggaattagttaagtttattgtgagatagattattaaatagggggatatatagaatgaaatatgacaagttaccattacaatataaatttgaccaattagaaccatatattgatacagaaacagtatgtatacattatacaaagcatttacagggatatgttgataaattaaataaggtactagaaggatatgaaaaatttactgatgaaaaaacattagaggagatactttttaatattgaagaaactcctatagagataagaaaagatgtaataaaacaaggtggtggagtagcaaatcacaatctttatttttctattttaggtaataaacctaaaaaacatccaactggggaattattaaatgagataaatagaagatttggagatttaagtacattgaaagaggaagtatcaaataaggcgataaatcaatttggatctggttatggatggcttgttatagataaaaagggagagcttgatgtgatatcaacatcaaaccaagattcaccattgatgtttaaaatgagacctatattaacaatagatgtttgggagcatgcatattatttaaaatataagaacttaagagctcaatacgtaaaaaatatatggaatgtgatagattggagtaagatagaggaaatatatttaaaagagtgttctaagtaatgggcataatatcatggtataagactatttagatttattaacaaattaatagtgaataataaaattaaagaagtatttaaaattcatgggatacaatattataaagttacagagtttttaccacatcattttaataaatcaccagataaatggttcaattaaataataaaaatagtaaaagaagttagataatatctagcttcttttactattaaaaaatttttagtgaaagtacataattaaattttaaatcccaaataaatttcacaaatagctgtaactataaagaaaatccctataatataaggtgtagctaatattgctataaatggattaaataatattagtaatcctaaaataaataaaaggattatgtatattgtatgaaagttaaatcctaaatttttatatttaattgccataatgaataaataaattcctctaataagtgcccataaaccaaaaaataatgcaattgtatcaagggtttctgtaggtgagaaacaaagaagtaatccaaataagattgaaattattccatttacaattaaaaaaacattatttagagaggtaaatgatctaataattgcaaatatcccagctactattattaatactccacaaatattaatgaaacttgaaaatgtactaaaaggattaatgaaaaataaaatacctattattccaaataggattccttcaacaataaatagatattctaagaattttttcaaaaatatcactcctttaaatgtttgattatgaaatacatctttagtttgtgataaatttataatattatatataaaattttctatttaaatataattataaaagtagtaaggaaaataacctcttttgcaattattttattttatgataatattagtttaatagaatatatattatgttaagaaagcacacttataatataataaggtctatattgtaggaataagaaagtaaaatgttaaatggaggtatggtgtgataaagaaaacatgtaaacagtgtggaagagattttactcttactgattcagaagttaatttttataagagtaagggtttagacattcccaaaagatgtagtgagtgtagaaagaaaaataaaaataataacaataatataaataaagataatataaataataagcaagaaattaatagttacagtaataatggaagagataataagaagaataataaaaagagatatacatttggaagtgttatagccgcaggattagttattatacttttacttgttggtaaggtatttaacataaatcctaattggggtgaaatatttaatacaactcaaaatgagcaaactagcaatgtatctcttgaatttagaaatgaaagtctatggcaagatcatttcttgaagcatggaagtgagtttggatactctactaaggaggagtacttaaacggagcaaataaagttattaattctgcatcatctttacataagttagaagctgaagataatgacgaaatttattatgatgaaagtaagaatgagattgtttttgtatcatctgatggatatataagaacttattttagacctagtgaaggaattaattattataatagacaataaaaaagtatctatagtatatttgaaaattgatttttgaatatactgtagatattttttttataattaattatgaaataatgcttaaaatcaatggctaaggtaattcaagtaggaataaattaaataaaagttatatatggatatttcttaaatgaatatattttttctcttaatgttttataaaaataacttttaggaggtttatataacatcttataagtatttgaatatattattataagaattttaagaatcgtataggagaaaagaaatgatcaattttaatgaaattcctattatcgaggaaggagagaaatatataaaggaatccattgaaagttataaaaaactcagtggagatggggtatttactaaaaggtgcagtaagtggcttgaagataattttaagttgaataaagtactattaactacatcatgtacccatgcattagaaatggcagcaatattatgtgatattaaagatggagatgagattattgcaccatcatatacatttgtatcaactgtaaatgcatttattttaagaggtgcaaagatagtttttgttgatataaggccagacactatgaatatagatgaaaatttaattgaaaaggctattactaataagacaaaggcgataattgctgttcactatgcaggggtatcttgtgaaatggacaagataatgagtattggcaaaaagtataatttatatgttgttgaagatgcagcacagggagtaatggcaaaatataaaggaaaagcgctaggaagtataggtgattttggatgttatagttttcatgaaactaaaaattatgttatgggagaaggaggtgcaattgtaataagagataataagtatatagaaaatgcagaaataataagagaaaaaggaactaatagaagtaaattttttagaggtgaaatagctaaatacagttgggtagatataggctcttcatatttaccaagtgagttaaatgcagcatatttatacgcacaattagaaatagcaaagaaaattaatgatgatagattaaagtcatggaatatttattacaatggcatgaaagagctagaggaaaataaatatatagaacttccttatattcctaaagaatgtgagcataatggacatatgttttatattaaaactaaggatttagatgaaagaactaggttaataaagtatttaaaagaaaatggtattttagctgtatttcattatgtaccattacattcatctgaggctggggttaagcttggaaggtttaatgggcaagatatttatactactaaagaaagtgaaaggttgttaagattaccaatgtattatggattaaagcaagaatctttagaatatatagtagataagataaaagcgttttataatcaataaaaattaattttttttaggagaatatacaatggatataatcggagataacattagcttgagaaaaatggaaattagtgatactaaaaatataataaaatggagaaataatttaaatgtaaaaaagaatttttttatacaagaagatttgaatgaaaagacacattattcatggataaaaaataatgtgaataaaggtaaagttattcagttcattattgtaagtaataaactgaacaaggatattggaacagtatttttaaaagacattgataaaaaaaatagtaaagcagaattcggaatatttattggggcggactctgaaaggggaaaagggtttggaactgaagcagcagtattaatatgtaattatgcttttcaaaacttaaagctgcatagaatatatttaagagtatttgatcataatgatcaagcgaaaaaaagctattataaggctggttttaggcaagaaggtatcttgaaagatgatatatttataaaaggaaagttttatgatgttgttattatgagcatcattaattcttaaggaaaggatggtatatgaataataaaagtatatgttttatagttataggagaggatcaaattaaggctaaggaatgtatattttttattaaaaatttatatgttccaataggatatgatatagaaattatagaaaagtataatataaaaaatagagcaaatttttataatcaagttattagtgaaaatgattcaaaatataaagtatatataaatggaaatacaataatattaaattcacactttattgaagatatgttaagcttatttttaaataaaagtataggagttttaggtatcgcaggagcaaagcaattacctgttagtggaaagtggtgggagtcaaagtctaaatatggggagttttatgaagtatttaatgaaaatgtacaactaaattcatttataaaacccaaagctgaatatgagaatgttcaagtaatagacgggagtattatggcaactcaatatgattttaagtggagagaagatttatttaatgataaatactttctttatgaatctcaatgcttagaaattgctaaaggtggatatgatattgtaatacctaaacaagtaaataaatggtgtctaaaaaaagatatagaaaaaatagatgaagaaaaagttaattattatcaaaagatatttttaaaaagttatgaattaatagatcttaataaagataatttatttaattttaatactgaaaatgctatgaatattataaatgaaaatagaaatagatatgaagaatatattgaatggataaatcaaaatttagatataaaaagatatgatattgtagcaaatttaatatatgaagtaagtaaagaaacttttttgaagcatgctggtatttttgcaagtcaaaagattgaggaagcactacaaaaatgtgcagatagtataaatagtaagagtctaaataggatagagaataaatttgccaagagaagagtactacatgtattgagcgagggatattctactggaggacatactagacttgtaaagcattggatagaaagtgatacagattctattcatagtgtaataacaacgtggcaagatataacattaccagcttggttagtaaactctgtgttaaacagtggaggtagcgttaaaagtttaaataataatgataaatttatggagagagctactatcctaagagaatatgcatacaagaatgctgatatagtagtacttcatattcatatgtatgatccaattgcattaattgcatttggagttaaaggaggtccccctgttttattattaaatcatgctgaccattgtttttggataggagctagtattgcagatgtaataattgattgcaatgagtatggaagtaaaataactaagtataggagaggaagaagagaaggtactattttaccaattccactaaaaaagcctggagaactaaataaatatgaattaagaaaaagatataatattagagataataagaaagttatattaacaatagcaactgagcataaatttaatagtataaatgatatagattactgtgaaattgtaaaatgtattttgaaaaatacaaaagatactgtatttataattattggacctagaaatgaagggaaatttaaaatgctttcagacattagtgaagagcgagttttggttttaggagttcaaaatgaaattgaagaattttatcaaatgtctgatttatatttggatgtttttagtatgggaagttttacttcagagttagatgctatgttaagagggttgcctgtaataaagtttaagaacaaaatatatcctaaattaaatactatgtttgatgaattagaattattaagttttgaaaatattgggcaaataatagattgtataaatgaatatgaaaatgataaagaaaatagcattgttcttaaagcacaacaaatgaaagaatttgtattagaaaataatgttttaagaactagtgagtatataaaaggtatatataaatcggttgatgagcatttgatatataagcttaatatagaagataaaattgattattatgatttatattgggctttgtttaatcactagtaattttttgaagagtgaattaattgctgaaggaggaaattaacatacaatataagtattttaatttcctcctttctttaataatattggattaagaaagtttatattataatattttttatttattgacttaaaaaaactgtagtattatttgattaccataggtatattgtaaaatattattcttatcttaaaaaaatatgattatatttattctattaatattttagcaaaacaacgattattatcttatattaattattcggattcagtatctcaataagggaaaaaatttttaaaggtatattaaaatttatttaaagtatctaaataatattaaaataggaatacatttgttgtattcctatttttttatataaaaattaattatactatctccataagaaaatttgctatttattataaagttaaatttaatcaagtagtcatggaataaagatagattatttgcattttctgcattaggatcagtatataaggttgaggaaataaatatagcaatatttttagcggtttctaaagctttaaaaactaagtttttagccataacatctgttaaaaatttatctccatcatttattaaaatataatcaaaatcaatattattgctatcaatagaaaaagttttaaatagcttattggctattttatatgaaccattagagctatctccaatataaaaatcaagatttcttctataaaacttaagcattaaaccattaacaccacaatttccgtatacatctaatatctttaagttttctatttcaggaactaagtttaaataagctaaattgaaatgaacttctttaatatcaattccccattttttttcgaatttttcttgattttcttttagcactttaccataggaactatcttcactaaacgaagcactaccatagtgatgaacaaatgtatctctgcataagagaagtttatatcctgcagttattattcttaaacaatagtcatcatcctcaaaatttccagggaagtaaatttcatcaagtaatccgactttatttaaaactgatcgtttaataagcatactatatccaaccagcataatcctttcttcccaattagctttattacttatatttattttagaagcaaagtcttgcatttcatctattgttttataattaataggtatactttgccagtatgaagaggaattggttataggactaacagcacctatattttcattactatataaggcagttcttaagtttgtaagccaattactagtaacaacaatgtcattatttaaaagtaaaatatcatttttaggattagctagttttataccatcattacagccaccgggaaagcctctattagaagtatttaattgaagttttatatcatattgattttttaaccaattttttgtttcttcattagaattattatctataacaataatttcatagttttcattagaggtatattttctaatactttctatacattgtttagtgtaatttaagttattataacttaaaactattatacttgttcctgtatcgttatcattagaggaattaatatttgatgatgaatgagtaaagtattcagctaagaccttgtctctataaaaataatagttttcagtactaacatcaccacaatcatgaattatccaaggagtattttgttgaggtattacaatttttttattttgttttaagaattcaagtgattgcgaaatgtcatagaaatgccaaccatctaaaatatcttctctccaaggtatatcaaattgtgtaattagaataaaaccatctaatagagaaacttcttcatatttattttgaggggattggaaggagagaagtgttaaatgagaatttcttatttcatataattctccaaaaaggtttgaggcttcccaccagactagtgaagatggaatttctttagagccagcaaaacctattaatcctatttgattatctgtaaatatatctataatattatttaaaaaattaggattaattatatatacatcttgatgtaggtatattttatattttccagttgcttttttcataccttcgttgtatgcacttgctagagaatttgcgtttctaatttgtataatttcaatactataatccttaggaatagttaattgtgatataaaacgtaaggaattttctaataatacatcattattaacacaaaaaataaaactaataatataattattatccatacgatgcctcccaaaaaaatatatagtatatagtatgaaagtaataaattaagtgattcctactattaatccaagaaggaataataaaactcaaagacacttatctttatgaggacaatacatacatatttcttcaaaatatctatattatttatagccttcgcgagtcgttgttttatatattaaagcaactttcaaatactttatttacatgtaaaagtatttaaaaatatatcaataaataaatttttggaatatatttaaatgaaaaataatataaataaatgattaatttttttggagtaaaatatatgatagtagctgatagtactatcttagatcaaattagacaatatcaatataagcctaataattattatatgaaaaaacaagtataattattttatcttataacgaaattgcttgtacaaaaatatgtattgagagtgttagaaaatttactgataataattttattgaaattatagtagttgacaatgggtccatagatgggactgtagaatagttgaaaaaacaaaatgatttagtatgctttataaataaagagagggaatatcaatttaaagctgataagtattatctaaaaatatctaaattgaattaatttataattaaaatattaataaattaggagatattgatgaaagtaaggaaagctataataccagcggcaggattaggaactagattattacctgctacaaaagcacagccgaaagaaatgcttccaatagttgataagccaactattcaatatatagttgaagaagctgtgaattcaggaattgaagaaattttaataataacaggaagaaataaaaaatcaatagaagatcaatttgataaatcaatagaattagaaatggaattagagaaggctggtaaagtaaaagaattagagattgttagaaatgtatctaatatggtggatattcattatataagacaaaaagcaccaaaaggtttaggggatgcaattcattgtgctaaatcttttgtaggagatgaaccatttgctataatgttaggtgatgatattatagatagtaaagtaccatgtttaaagcaattgatgacgtgctttaatgaatataaaacatcaatactaggtgttcaaagagttgatgcaaatgaagttatgaaatatggaataataaaagaattatatattgaagggaatgtatataaagtaaagggagtaattgaaaaacctacgttagaagaggcgccaagtaatattgcaattttaggtaggtatataattactccgcaaatatttgagatattggaagatactaaaccaggaaaaggaaatgaaattcaattaacagatgctttacaaactttaatttcaagagaagcaatgtatgcctacgaatttgaaggtaaaaggtatgatgtaggtgacaaattttcttttttacaagctaatatcgaatttgcattaaaaagagaagaattaagagaaaagcttttagaatatttaaataaaaataagtggtaaagatgaaaaacctatggatttatattgaattttaaatctataggtttttttattatttaaaataatattttgattttattagtatatcaagtttttcacaaagtttaatccaattaaaattatttgaggtaaagttttgtatatcagtacaagcttctttaagtttgctttcattattgcaaatggaagttaaaagatctgcttatttattgtctaaagcaatagtaaatgttatagtttaaataaaaaaagatggagggaaataatgaaggaaaagttaacagcacttccacctataggaatgcgtattattaaatcatcaattggagtactgttaggatttattatttatttaattagaggaagacaaggggctcctttttacactgcattatcggtattatggtgtatgcagccatatacaagtaatgcaaaagctaatgctattcaaagaacaataggaacatttataggagcgttttttggactaatagtgatattaatagagttttatttattgccattagacaatgaattaataagatatattttaatatcaatactaataatacctgtaatatatacaacggttataattaataaaaaaaatgcttcatatttttcatgtgttgtatatttgagtatagtagtaaatcatcttactgataccaatccatatttatttgttataaacagaattttagatacaatgattggaataattttagcattaataataaatacagcaagaattccacgaaagaaaaataaaaatgttttatttgtatctgagttagacaaggtattattaaatatgcaatcaacgttaacaccatatagtaagattgaattaaataaaatgctagatgatggagcaaagtttacaatagaaacaatgagaacaccagcagctttattagaggcgttaaaagatataagaataaaattaccagttgtaactatggatggagccatgctatttgatataaagaacaatagatgtttaaaactatataaaatgagttatttagaaagtaaagagttaattaatttatttaatgatagagatttacattgctttgttaatgtagtggttgaggattcagtattaatatattatggagatttcaaaaatgaggctgaagagacaatatataaagaattgagatattcaccatatcgtaattatataaaagaagaactaccagaaaggtatggtgcagcttatttaatgactatagataaaagtgaaaaaatagatgaaatatatgaagaattaaaattgaaaggatatgtaaatagatttaagattttaaagtatccatcggaagattttaaagggtattcatatataaaaatatataataaaaaagctaataaagaaaatatgataaatgaaataaaaaaaatggttgatgttgataaaataattagatttgaaactactcaagaatcaacaggtgtaataataggtaaaaatgattcaaatgagatggttaaaaatttaaagaagatatatgaaccgtatttctgggagaaacaataaaaagttatttaaaaaaggatgtataaataattgctatttaacctaagcaaatttatacatcctttttaatattttatacaaatgtttcacttgatttattagctttatcaatttctgataaggcatgtactctaagcatattaattataactgaaaaaaaataagcataatataagttttcataaggtgttaaattagtattttgtgataataagtcattttgtaatttcttctcttctaatctgtcagaagcaacaatgaataatatagcatatccaactaatattaactcagctccaagtaaagtgactgatgaagctgtttctccagtattatttatatctaaactatctaaaatatctatgttagctccatgaatgaataaaaaatatccaattactaataaagaagaaccaaatttttcgagtgatgcaaatttaatatctaattgtttaaaatactcatctaattcttcagaactattttctttttttttatcttgcaacttaatatcccccatagattgatttttacgaagatatcatattatataaatatatgatttataaataggttttgtacaaaacatatttataaaaaaagaaaaaaagaaggggtgtcccttctttaataatagaactatataaataatgcatccttataacgtctattaataatataataattttttaatagttcagtaaatacttttttcaattcaactagttttattatgttggtatttatttcgcttaataaattctcccacaatggatttttattataattagtatcttcaataaataatttaaataaatcataaattaatttagagttgtattcaccaatgtgttgaatagtttttggattatttaaattgagtatagctttatttaaagattctttattgcctaatgaaaaataaattaaagattcaattacgctatctggaattattaatctatgatcaattatgccgctattataagataaatattcaagtgctttattgaagtcatttaatcgataataagcccaagcaataattgagttaaggtgttcaataaaataaatgtttttgaattttttagccatattcaaagaaatttctaaataattaatagcatcactataattatccaacataaaataaacttctgcaatcttttcataagaagacataatgcttataatattaccttcagcaacatataagtctaaagctttattaattgaatcgtaagctttaatcggattattttcaattctatatgcatatgatagccaaaaataacaatgtccagtttctttaagtgataaagcttcttgaatgagctctttaccacgaattttattattagaaagtattaatatatctattcctgcatagaaattatatatatgtttttgtttagaagttagcaaatcaaaggatgataaaagcatattttgagaatactcaaacttatctctgtttggggtagatgaatatctcgctaattttgctaagaagtaatcaagtatcaaaggcgaggctaaatatttatcttcatctttttctaaattatcgaataatttgttagtgtaatcaaattcattataattcaaattagtaaaaaaatcatttaagtatttttttcctctttgtaaaaattcatcagaatcataaaattttaaaccaagtctatcaaaaataactgaaattacatcttcacttggtaataattcaccattttctattcggcttaaatatgaaggaacacagataccctttgataattgtttttgattaatgtttttattgattcgatttaatttaattatagatccaattatttttttactatttacatatttatcaatcatttattaatcctctcaaccatagttaaaattaatttttatttatagtaattaataatataatgtatttttatttgggtttactatagtttactataattggggtatcacttgcaaaggtattaagaaataattactactttatgattaacgctttagacttagaagtggcttaaataggtgaaaagagaggaatgtgtgaaatcattgtaaaaaaaaggtgcttaaatatatataaataataccaaatttaacataacatattttattttaattattgacgattatttatgaattagatataatgtaaacataaacaaagaaataatatttaaaaatgaaaaaaattaacaattcctttttaggaatttattttttaattttattggaaacgatacctaaaagtgtttcatgttgtaatatatttgtattgtagtagtttttatagtaaacaagctagagagttatctttgaattactcatgaaaacattttcaataattgaaatcgtttctgaaattacttatttgtaaatatgtatttaagttatattaactttaaataaattgatttttgtaaaagtggaggagaattattatgaaaaaattattagtaacattacttgttgcagctacttcgttaaactttgtagcttgtggatcaagtgataatggggatagcaaaaaaggacaagaaaataatacagctacatcatctagtaatgaaaaagtaactttaaaggtgcaagctgaaaaagactggatgtcttactatgaaaaggttaaagatactatagtagaaaagtatccaaatgcaacaattgaattaattgaaacaggatcatttgatcacctagatgtattagatcaaacagatgcaacaaactctgatgttgcagacgtatttgctttacctgcagatagattatatggtttagctaaaaaccaagttttagctgcaatgcctgcagatgaaatggcagaggaagttggaggatttactaatttcgatgaaggattaggtggaaactttaatattgatggagaatatttagcattcccttacaacatagaaacattaattggttatgttaatttagaaaatgcaaaagctgcaaacatcgatacaactcaaaatatagaattcacagatttagaatataatcaaattttaactacagttcacgatgcttggtatggagttgcatttacaaattcagctgattttgaattattaacaaaagaattaacaagtgatggaactaaagaatgggcagatttaactgaagagcaacaaaaattatttgaaggattatataactactggaaaggtcacaaagaaaataacacatctttatgggataaagatgcagctagtggatatatagaagaacaattcaaaactggtggaagcgatgttatcaagatcgatggaccttgggcaacatcttcagttagtgaattagtaggaagcgctgaaaatatggaaatcattccattaagtaaaatcacatttaatggacaaccattaaaacactggaaaggtggatggggtcttggaataaatgcaagatgtgaagatgatgaagctaaaatggaagttgcacaagcatttataaaagaattagttaacccagataacgctaaagaattattcgatgctactggtaaagtattagaaaatgctacaattgcagattatgaaggaattgatgaattacaattaaaagttatagaagcaacttacgaaagttatgaagtagctgaaaacagacctctattcagtgaatatggacaagtttgggatacatggcaaaactctttattatcatggtcagctaagaatcctgcaaatgcagaagaagcatataaagaagttaaagcttcatttgatggtatgatgtctaactttaattaataaagttaaatataaatttaatagtatattaagatgactaatttaagtcggtagttgttaattgaagcttaaatagaaactccttcgggagtttcttaaatattaaaaataacttattttccctttcaatcaatgagtaaataaagctttaagaccaaagaaaaatgctactagcttaaatttgtttattatattagtaggaggatccacatgagagaaagtatagaaatgcccaaaggtacattttatacaattgtagcaatatgtgcagcaattataatgatgacatctatggagatgttaattaaagctaaagatacaaatttatttaatatgtggttatccactagtaatttaggagaagatgcgctaagtcaaacaacaaaagaattattttctacatatttaaatgtatgtatatcaacattctttattagagtaataaccccaatggctatagctattcactgttattttacttttacaaaacttagagtcactaagctatttgtagcaatatggattgtaattataataggtgcatttgcattaacatttttaggagaacaattttattcaattttctttatcggaagtgcaattggttatttagctttaatttttgcaatgatttacttagggaagtgtattagaaatgttagaagtatttaattatgaagttattcagagggtataaaaggaggtaaaaaggttgaaaaaattcaataagcatttatatgataatattaatcgagagtatgatagaaaaaatttatacctatatgaagtttcagttttacaggaaaaaattgaggctgcaactggtaaagaaaaagaagatttagaaaagcaattaaatgagttagtaaaaaataagaaagatcatccttataataaacaattggatgaatataagaaaaaagaaaaagattttttaaaagaagttaataaaaaggtggaggagtataaaccaaaagttgatacagaattaccttcaaaagtacaaaagttagaattaaggttatttaaggctaaagagttagttaatttctataagaattatactaaacttacttatgatgctgaattaatatatgagcaatcaaaaatagaaattgctcaaataccaccagtaattgaatttgctaaagaagcaacaaaagaattgaaagaagctcaaaataaattaacaaaaataagttcaatagataatgaaaagtttaattctgaatttaaagaatttaaagataatgaaaataagaagttacatgatagaattagtgaaattaaatctaagtgtaaggaaggtttaatttctagacaggctaaagaaaatacaataaaagaattaaagagaagatacaaagaagccatattagttaaatcatttgaatgtgaaaaaacatacaatgaagaaattataaaaaataaaaaatatgagctttcaaagactattaaacaaaaaataaatactgttaacattaatgttgcagatttaagaagagtttatccagttgaaactgaaaaaacattaccttgggtatcttgggttacttttttaataccaggacttgctcaagtagtgaataaacaatatgtaaaagcgattataatgttctttgcaacaatatatatatatgctatagctattccatatgctttaggatatggaaactataaaggagatgggattgcaggccttataactttagctgctgatggaggcagacttgatagatcgattattttcatgattgaaggtatacttgcaatattcttagtattaatcggtattttcttaatgtacgtatgctttaaggatgccaataaggttgaaaaagatacaattaaaggaacgagatttagaagttgggttgaaactaaacaaactttatttgaagatggattcccttatttagttttatcaccggcagctataattactatatttatagtatgtattccagttgttacgacaattcttttatcattcacaggtatggggccagacactcaagctaaatttgggtgggaagcattaaagaactataagatgatcttcttaggtcaaggtatggttggttctatattctggagaatattaggatggacaataatttggactattggagctacaactttagcaattgctttaggatttattttagcaatagttcttaataatgacagaattaaaggaaaagtattatttagatcaatataccttttaccatgggcagtacctgcatttatttctatactattctttagtattttatttgctgatggtggaactgtagttaactcattgaggaatgtttttggaccaaacttctcaataaagaatgatacatttactataagacttacattaatttgtattcaggcttggcttggtagtgcatatatcttcttactatctacaggagttctacaatctataaatgctgagttgtatgaagctgctgatattgatggagcaacaagctttaaaaaattaactaaaataactgtaccgctagttttattccaaacagcaccacttttagttggacaatatacatttaactttaataacttcagtattatagctttatttaataatggaggaccatttgatccaagtaaatatggacacttagcaggttcatcagaccttttaatatcttatatatataaattaacaatgaatagccaatatcaagctattggagcaacaattactgttattatttcaatagcactaataataattgcatatataggatataaaaatacagatgcatttaagagggggtagtgatgatgagtatatttaaaaagaaaaaaaatgatttatatctttctgataaacaacctcttactgttggagggaaaattgcacttggtatatcatatgcattcttaatattatggtcaataatggtaatagtaccaatcggacaaattataatatcatcatttaatggagaacaagtaaatagactaataattgggggaaaatttagtttctcattaaaacactttaaaacattatttgaagatacgctttatttaaaatggatggctaataccttatttgtaagtattacgacagcaatattagtaatattaatagtatcatttactggatatgcttattcaaggtacagatttaaaggtaaaaaagcatctcttatgacagttatgcttattcaaacaataccaacatttgcaggaattacagcttactttacaatgtattctattgcatcagatataatgccaggtcttacaagacaaatgatgcttatattaatatatgctggtggaggtatagctggtaatacgataattctaaagggatatttagattcaatatctacagaactagatgatgcagctaagatagatggatgttctagtatgaaaatatacagacttattataatgccaattgcaagaccaatgcttgcaataataggtttatggtcattcataggaccatttggtgattacttattaccaaaagtattattaaattcatcgtctgattatacgttagcagcagggttacaaacacttataacagatgaacgtactataaatcaaccagcgttcacagccggagcacttttaactgcaataccgatagtaatattattcgttgtactacaaaaacaattagtatcaggtctttcaaatggggctacaaaaggataggataggagatagtagatatgaaggtaacattaaacaatattggaaagaaatatgaaagcagagaagattttactttaagacatataaatttagaaatagaagataaggatttctgtgtaatcttaggaccatcaggatgtggtaaaactacattattacgtatgattgcaggtcttaactctataacagaaggagatttaatatttggtgagaagagagttaacaagcttgcatcaaaggatagagatatagcgatggttttccaaagctatgctctatacccacatatgactgtatatgataatatggcattttcattatcaatgagaaaagaaagaaagaacgttattaatgaacgtgttaatgaagcagcaaaattacttcaaatagaaaaatatttatattctaagccatcagatatatctggaggacaaagacaaagagttgcattaggaagagcaattgtaagaaaaccaagtgttttcttgatggatgaacctctttctaacttagatgctaaattaagagagcatatgagagttgaattagtcagaattcacaaagctcttggaacaacatctatttatgtaacacatgaccaagtagaagctatgactatggctacaaagattgttcttatgaatgatgggaagattcaacaagttggtaaaccatatgaattctatgaaaaaccacaaaatatgtttgttgctagatttattggatcacctacaattaatatgataaaaggtaaaatagaaggaaagaaattcatttctgaagatggattaatatctatcaatccttcagaagctgatttaaaagctttatcaaattatgaaggtaaggatatatatttaggaattcgttctgaaagatttgttggagattctgataaagatacatttgagtgtacagtagatgttattgaagttttaggtaaagaacaaactctttatgttaaattaaagagtggcaaggaccttgtaataacagtacctggatatcatcaatatgaagctggagaaaagcataagtttggatttgatctaagtgcattacatttcttcgatgctgaaactcaattaagaattaattaataagaaatagtaaaaactataataaaaccataatattctaaagttggaactaaacccgatagttccaacttttttttatttttaataacaaagtatattttctatttaaacatgatattgaaaacatagagtacttatttaaatacgaagagaatatagtttataaggggaattataaagaaaaatatatatatgaggggatataaagtgtatgagtggctttgagattgttacaggagtttttggtggactaggtttatttttatatggtatgaaattaatgagtgatggacttgaaaacgttgctggagaaaagttaaaaggtatattggagaaaataactagcagtaaagttataggagtacttgttggaactattgtaacagctattatccagagttctagtgctactacagtaatggtagttagttttgttaatgttggattaatgacattaactcaagctacaggagttatattaggttcaaatataggtacaacaattactgctcaaatggttagttttaagttagaaatcatagcaccaatatttataggcgtaggttctatagttatgatgtctgcaaagaagaaaagaataaaggatttagcatatattgctttaggatttggagtattatttatgggcatgggactaatgtcctcttcacttaaaccagtatcaaatttacatatatttaatgagtttatttctgtaataggaaaaaatcattttcttggtgtattagttggattaattatgactgcaatattacaaagttcatctgcaactacgggtattttagtagcattagcaaacacaggaaatatagatattaatgtagcatttccaataatattagggtgtaatataggaacttgtattactgcaatattagcaggattgacagcaaataggacagcaaagaaagccgcgttattgcatttgtcatttaatatatttgggacaattttattcttaccattttcagataaggtagttacagttgtaaattatttaactccagacaatgtagcaaggcaagttgcaaatgcacatactatatttaatattgtaataacaatttttatattaccaatatcaaaatattttgtaagattagttaatcgtatattgccagattatgaaagtaaagaaagttatggagcagtttatttagataaaaaacttttagaaacaccaatagtagctagcggacaagctattaaggaaataataagaatggctaataaggcaaaagataatttagaattagctatggaggtatttttaaattggaatgaggaaaaaatgaaaagagtatatgataatgaaaatattattaatacattagaacgtgatataactgagtatttaatagaattatcacaacataatttgccagaggagaatgctaaattagtaagtaaagcatatcatactattaatgatattgagagaataggagatcatgcagaaaatatagttgaacttgctattcaaaaatatgaaaaagatattactttgtctaatgaaggtgataaagaggtacgacaattatttgaagttactttaaagtctataagtattgcaattgaatcttttaaatctaatgaaataaacaatggggatgaagtagaaaaaattgaagaagaaatagatagtttagaaaaacaatttagagaaaataatataaatagattaagtgcgaaaacatgcttagcagatgcaggaataatgttttttgatcttttatctaatctagaaagaataggtgaccatgctaataatattgccactgtaaaagaaaagccaagtcataaaattgatacagaattatgctaataaaggagttttatttattataaaaggctatgctttgatttttttataaagcatagcctagtttttaaataaataagttttttatatcattaatttttttagtagctaaatcataaccatggttatagttagctttaagcttattaacatctttttcaaagctttctaatgaaaattcaggtcttaaaataagtgcctttccttgactttcaagttcttcacaaaatcttactatttcattataattatcatgacgatttaagagagcatcttttaacttaggatatttactattaagtaattttgctacgataatattctttttgcttaattcttttttatatccttttggttgagttaaaattattaaatgcttatcattaccatcttcaattgctttttttattggaattggatcacaaatccctccatcataatattcatttccatcaatcttaattacaggaaaaaatataggtaaagcacatgttgctcttagcatagtggctttatcatctaaatttttaccatctaaatattctgttttacctgttttagcattagtaactcccactaaaaccttaccgggatatttcttatatgtatccatatcaaagggaattaatttatttggtatttcatcaaaaacaaaatcaagtccaaataaacttttgcatttcaagaaattcctatatcctaaataacgtttatcatttctgtatttggtaactacttcaaggttacgtcctttttgttgagagatataagagactccattagttattccggcagatacacctatgcaataaggaaaagtaatattattgtcaagtaatgcatccataactcccgcgctaaaaatgggtctaagagttccaccttctaaaattaaactaggcataaagcagctcctttcaataagttcttatttagtaattataaaacaaaataaactgtaatacaaatattgggataaagtttgctatataatgataataaatatttatatttaatataagttaagaatagtttataatataaagaaaagtataataaatttcaattaataattgttggaagtagaaaattaaagaaggagtatttcatgttttttataggcatatttggcatagataataagcttaaggatattaaagcattaaataatttttgctgtaaaaattgtaacattttaagtggagcgaggttaataaaatcttatactttctttcattttttctttataccaatatttaaatggaatgaagaatattacgtgatttgtaatgattgtaactcttcttttagtattcctaaagaaaaagggaaagctattgaaagaggggaagatatagaaatttcatattgggatttaaaagataataatataaatgataattatttaaaaaagcgatgtccaaaatgtaatagggaattagaaaagaattttgattattgcccatattgtggagaaaaaataaaataatcttttctatatgtgaagaaaagattattttattagttatgacaatggaacaagcagagtatgaaaagagatgttttagagaaggcaataagtaagagggttaaaaagtattatttagtaaaatggagctatattatatagaatatagttctatttttatgaaatatattataaaaagtcgaaaaatgtattataatgaaagataaggttaataaaatatacgttgttgagtggagatagcaatgaagagaaaaataataagtagtattataatagttattttgataggtgctggagctagtttattaatagcaagtagacctaagaatataataatagaagtagatggtaaagttattgaaagtaaaacaaaggaagctaatgttggacaagcaatagaagaagctaatgttgaattaaatgttaatgataaattaaattatgatattggagataagattaaaaacaatcaagtaatagtaattaatagggttgaaacaaaacaagatgagataattgaggaaatagcttttaatgaaatagttgttaatgactataaaactaaagttggggaaagtaggatcatttcagaagggactgaaggtgagaaaaaaatcacttatacagtaacatatgaagatggtactgaagttaataggcagattacagatgaggagataatattggagcctacagataaagtagtagcacagggaatttttgatccaagtagtttaactgtttgtgtaaataggaaaagtacactatcatccgattataaacctacagatctagtgctaccagatgtaagatcagttaatagcagtgatagaatatatatgagaaaagaagcagcaagtgcattagaagaattattcaaagctgctgaaaatgataattattatttatatgctgtatcaggatatagatcttatagttatcaaaaaagtatatataatccgtatagtggatattcagcgcctccaggggcaagtgagcatcagttagggttagctatggacataacattagctaaatataatgggacgttgtcagttgattttggtgatacaaaagaagggaagtggcttagagaaaatgctcataagtatggatttataattagataccttgaaggtaaagaagatattacaggatataagtatgaaccgtggcatcttagatatttaggcgttgatttagctacagagttatatgaaaaaaatattactttagaagaatattatggtgattattagaagtttttttatacgaataattaaatatggtaaggctttaaaagtatactaattatatttgaaaaaaggttagtacagagtatgaaagttaagataagttttattaataaaagtattaaatatgtaaaaaaactaaattataggtatagaattgaataaaatctagaaagggatttaaatgaaaattttagtagcttaataagaatatttgtcctatgaattattatatattttaataacaataatttataggaggaagcttgtgtattgtagagaatgtggacaactcataagtaatgaaagtcctaagtgtacaaattgtggaactgaaaaagggttaggagataattattgttacaagtgcggatcgataataaagaagcatgatttggagtgttgtgaattttgtggtgctgacttaaatgataatagatatgccgcaagagaaaatgtaaaaagtaaattaatagcagtatttttagcactatttctaggaggaatggggattcatagattttatttagggtatgttaaaataggaatagtacaattatcattatggattttaggatactttacaggtggaataacttggattattgcggaaatatggggatttgtagaatgtattttaatttatattaataaacttaaagactcaaatggtaatgatttagagtgaaaaagaaaaaatactgaatgtatattgaaaaggtagaaattttaaaaggtgaagcaggtaaacttgcttcaccttttattttatatagtaaaaaaataggttaacgtcttccacggccaggggttcccatattaccaccaccaggtacaccagaattactgccaccggttgttacaccactttgagatacattacttatagtgctagaaagagtaaaggaagtaatttcagtaccgccactagtagtaccatcagtatataatccatcagtagatgtaccagtagatgtacccccagagtaagcactataagttttaccagtttctaattcaggagatgaaataataacagattgatatgactttgatggtgcaaatgaaattatgtcttcaccagattcagatttaatagttaataagctatttgctgatccattaacatatacattaattgaattttgtgttgaagaagtacttggattttgtgccattccagagcctccagctgcaattaaaataccaccgttaatattaaaagttgaatcatagtctaaggcaccatttccattatcttgtggtccatttactatgactgtaccatcatttagttcaattgaaccattagcatcaataccatcaccagcagcatcaacataaacatatccaccattaaagtttatttgaccatttccagaagaaaagctattttgaccaggtcttccacttgttgaagaagagtcattcccaccagatgcgtttattccatcatcactagcaactaaatgaatagtacctccattaatatttatagttgtactttctattccttcataagatttacttatatttatatctccaccgttaatatctaaggttgtatcagagtgaacaccatcatcaccagaagaaatatcaatagtacccccattaattacaacactattgttagaatgaattgaatcgtcagaagaatcaattgtaaaagtaccaccatctatagttattgtattaacggctttaattgctttggcactgctagtatcagtagtagaacttgagctgctactagagctagtgccagtgccccatcggccccatccactttgatcattgctactcttagagctactatttgcacttccaccaccagtagtaatgtttatagttccatcagatatatttacgttgctttcagcttgtattccatcattagttgaagtgatatttaaagtaccaccttgaatatcaatatatcctttttctgtatcttcagcatttgtagattttaatccatctccagaagcattaatagtgatatttccatcttttatagtaatagaatctttacccattaatccatcatcagcagaagtaactgtaatattaccaccagtaatttttaaatcatctttacttgtaataccgttattataattagcattaactgttagggtaccatttcctctaatagttaaatcatctttactaaatattgcagcattaggttcatctgtagtagagtcttcaaacacatatgaatcactatcagttacagtgttagttgtatcatctggtaagactaagattgcattttttgcagcttgaacatatataggtgcactgtcattagaagtaatatttacattgttaagtattaaatatacattttcttcagatacactattaacaattatttgggcatcagaagaagtaccagttatttcatatactccgccagatgtaatagttactttattatcagagactgtagcgtcatttccgcttacagcaattgaactatctaaattaatagtacaagtaacttcaccaatatcctcgtctaattctaaatcggaatttgcaactgtatttgtagtttcttgaacagtagtatttgtatcgttattagcatcagttgtagttgttgtctttgagcaagctattgtactactacataaggtaacaacagttaataatataataaactttctcttcataatttcctccaaaatcatttaagtaataattttctattcataagaaaattacttaagctttaatttaatatcatacttataaaatcatattaacaataaaaccttaaattaatcttaagtgagactccaaatcttcgatttggtcagacgaacttacaccccaggcgtaagtgagactccaaattttcaatttggtcagacgaacttactcatccgagtgaagggaggaggagtttccttttttgttattaagttttcatagaaaattttttgtttatagaaattatttatttttactaaaaaaattatttactatataaacataaaggaaaatgtaaaattcaagagcataattgtaaaaaatagtttaaatataaaattcttttaagatttttttaaggttaggattttataatgacattaaggattttaaataatacgttttgggaggtatttttatggcaataaaatcatttaagagatacgaaaaaaaatatctgttaaatcaaagtcaatatgatgagcttataaaaagaataagtgaatatatggatgcagatgagcattgtaaaaatggtaataactatagtatttataatatttattatgatacttttgataatcaagtcattagacattcaataaataaaccctattataaagaaaagcttagattaagaagttataaaacgccagttagtaaagaggataaagtattcttagaaataaagaaaaaaataaatggtgtggtaaataaaagaagggtagttttaacactaggtgaagttcaggatttcttaaataaaggaattaggcctcaaaaagatgattatatgagcaatcaagtattaaatgaaatagaaaattatttggaaaataataatgttaagcctaaagtttatataagttatagtagaaaagctttcttttgtaaggcagataaagattttagattgacatttgattctaaaataattacaagaagagataatttggtattagaagctggaaattttggtgatgaacttttagaaccaaatcaatatttaatggaagtaaaaatattaggagcaattcctttatggttagtagaaatcttttcggatttatctatatatagtacaaagttttcaaagtatggaaatgagtatatgaggtattgtttaaataaaaataaagaaaatgaaatgaggagagtaaaaatatgttagaaacgataatatcatcgacgaatggagagtcatttacattagcaaatgcattattagttataggttcatcaatagtattggggttagtaataagtttagcttatatgtatactcataagaaagaggggtatgcccctggatttacaataacattaataatgttaccagttataattgcaataataattcttttagtaggtaataacgtagcaagagcatttagtttagcaggtgcattttcaataattcgttttagaagtgcccctggagatcctaaggatatatcttatatattctttactttagctgtaggtcttgcgtgtggtatgggttatataggatatggtgttatagtaactgtgatcttatgcatcatcatgattgttttagataaaataaaatttgcagttccaaagactaagaatatgagattaaaaatattggtgccagaagatttaaattatgaaggcgtttttgataaaattttagatagttattcaactaattgggctactgaaagcgtaaaaacaaaggattttggtgcattatttgaaatatcttataaaattcatttaaaagaaggtgtaagccaaaagaagttgatagatgaattgcgttgtaagaatggaaatttaacaattgcattaacatcagctggattagaagaaaaagtttatttatagttataattaaaaatggtagagattttataaaatctctaccattttttatagtttatgaacatttatagccatagggcctttttcaccatctgcaattgaaaatgatacgttttctccttcatgtaatccactatcaggaccattttcttttaattgagaatgatgaacaaatatatcatttccattattagcagatataaatccataacctttttcagaattaaaccattttactacaccagtataacttgacatataatcgctccttaatctataagtaatcgaaaatagtttatgtaaaagtaaaaagtttattctttagagttaattttagctattttatctttatcccatatgaaaagttgttctgaattgttaagtgcagaaaataacttttctttgaaattaggaaatgtactatttaaatctctaattaattctttcatatcctgtcttttagtatgaccatcagcaggacacgggttcttaataataggataatcatatattttaacagcttttttaatcatgtattcatcaatataaaccattggtctaataatagtaatatcaaacttttccatatatgattttggggagaaacaattaattcttccttcgtaaaacattgtcattgcaaatgtttcaactgcatcatctttatgatgccctaaggcaactttagtacaaccaagatcttgtgcagtaccatttaatgcaccacgtcttaattttgcacataaggagcaagggttcttttcatttcttatatcgaatactatttttgcaatatctgtttgaacttcataaaatggaacttctaaattcttacacaattcatgaagagggctattatcaactccaccaggatttaatgttattgcaataaggtcaaattttactggagaaaatttttgataattttttaagatatgaagaagagttacactatcttttcctccagacaaccctactgcgattttatcattttcttctatcatattaaaatcatttatagcttgacgagttttactcaataatttttgcatcatatgtttttgcctccgaaatttattacttagatattttaacaaagcattagtttttagacaaatagaataaaaaagataactaaacttactttttttcaagcacttaataagttagtcttgctaagttaatatttaggatttgagttaattcttataaatatcttgagctagtagtgttaatttttctaaatctaaaattttaattatatttttattcttttcaataatatttaattcagaaagatttttaataactctatttagatgacgataactagatcctaaaagttcagctaaattattaatcccatctatatcaactaatatttctttagaattattcgatggtaaagatgaaattaaatagcttgcaaagcgactttcaattggggaaagtatattaatactcatataacttgaatttcgtctaagctttttttgaagagaagaaattataaatcttaaaaatattggatcagtatagccgtattcttttatactatttaaaggtaatgctaaacaaatacaaggttctaaagcttgaacattacagtcagcataaggattttcaataagttcaatatcacccataatagaaagaggagtattgaaacataaaagtaatgatttaccacttgaaagtaaagtggttactttatactttcccttaactaagaaatacatataaaataatttatcatttaatgaacaaagaaattcatttttattaaatgtatgtatttctaaagagtctaataaatttttatttaagtatgagtgtaaagagtatttattaacataataaataagctggtctttgttgcttaattttttcatagattctcctttaaatatagataaaatgaaataatatatattgtttactaagtttatataaaaagagtatactattaaaaataaaataggacaaatgtcctattttatttttatatctatttgataagatgtttctagaaatttaactggaggaatttaaatgtataatattttagcactagtaattggagcacttatttctattatgatatcatttaacagcggattagaaggttatgttggaagtacatattctgtagtgattattcatgctgtagggcttatttcaatacttatagttgcagctgtaaagaaagaaaaaatagtaataaaggaggctataccattttatttatttttaggtggaatttttggagttatgcttacattagttaacataattacaataggaggtataggtgttgctttaactacagcacttgcagtatttggacaattagtattttcatccttagtagaccattttggattatttggtttaactaaatatgaatttaatcctaaaaaacttgtagggttttttatagttttatgtggattagttattatgacaatggcataggggaggaataaaataatatgttaatgattttattagctgtatttggtggtgtactaactactttatcaatggtagtaagttcaacactaggaaagaaaattggattaattcaaagtacaataattcattatataggtggacttattggaggaatttttattttaataggtatgggtagtgcttcagcaccgtctatcatagatatgagcagaatgccattatatattttcctaggaggaatcataggggtaatggttgtgtatacttctaatatagttattccaaagattcctgttgtatatagtacattattgatgttttctggacaaatgttgtgtgcaattgttattgatgcaattgtaatgggggatttttcatggcaaaagcttttaggagcaataatagttgttttaggtatattttataattcaaaagttgatgaaaaagaggcaaataagcttaaagaaaaaacagataagcttaaagaagcttaatacttaaacataaaaaaggaggagataatttttatatcaattataaaattatctcctcgttttgttacctttttatttaagatcaatactgttgtgcttcccttcaatagttctttgttaattttcataatttcatcaccatacattgtaattcgatacatcgtatatctatgtattatttttttttggaatattaaggaaaagcaaagaaaaaaataaattattgaaattttaaattaaaagatatatcatataagtaagaataaatgataataaataaaagtaaataaaaataaatgatattaaaagttatatataggaaaaggggtatttgtttatgtttatggaagaaaggttagatgaaatattagaaataattcaagataaaaaaaaggtgctagtaaaagatttaagtgaaaagtttagtgtatcagaaagtatgattcgtaaggatttacaaaggcttgaaaaagaaggtaaaataaagaggacttatggtggagcaattttagaaagaggcagagcttacaatgaaaatactacatcaagagtatttgttaacattgaagggaaagaacatatagctaaagtggtttgtgatattttagaagaagatgatgtaatattcttagatatatcaagtactaatttaacaattgcatcaatgataagaaatacaactaaaaatataacagtaataacaaatatgaatagaatcttaatggagtttgatcattcacctaatattgaagttattttagttggaggaacatttaataaaagattagggggaacagtaggggcttatactgtagagcaaataaagaattttaatatagataaagcttttgtaggtgctggtggagttaatattgaagataactttttaagtaattttaattttgatgaatcaattgttaaaaaggaaatattaaaaaatagtaagaaaaattatattgtcatggatgatgaaaaattttataaagatggagctcataaatttggaacattagaagaggtagactttataattacagataaagctccagatgacgcagtaaaagtagaattagataaatatgatgtaaaagtaatatattaaataagcaatacggggagagtagttatgattaaattaatagcaacagatatggatgggacattattaaattctaaaaatgaaatacaagatggattttatgaagtttttaacgagttggaaggaaaagggataatatttgcagctgcaagtggaagacaatactataatcttttaaaaagatttgagggtattgaagataaaatgatgtttatagctgaaaatggtacatttgtggtttataaaggaaaagaacttgtagttaatgcattagatttaaatcttgcaagagaactaattaaagtaggaagaaatataaaagattcatatgtaatactttgtggtaaaaaatcagcttatattgaaagtaatgataagagattaattgagcaaacagaaaaatattatgaaagatatgaaatagtatcagatttaactaaaattgaagatgatatattaaaggttacaatttgtgattttgcaggttcagaaaataatagtaataagtattatgatgattttagagataaagctcaaattgcagtatcaggggaaatttggcttgatataactgcaaaaggtattaataagggagttgcaatagcggaagttcaggagttgctaaatataaagcatgaagaaacaatggtatttggtgactacttaaatgatttagaaatgatgagtagtgcttatcatagttatgcaatggaaaatgctcatgatgatttaaaaaaggtagcaagattcagagcaaaaagtaatgatgaaagtggagttgtacatgctataaaagaaatattaaattaatatatagtaaaagcagagttattttgattaatgataattcaaaataactctgctttattttattatttacaatttaaattgccaggtttaacgttatcttgtacgtttcttaatgcttcaccaaatctttgataatggactacttctctttcccttaagaagcctaaaatctttttaatttcagcatcatctgttaagtttagcaaccattcataagttgctctagctttttgttcagcagccatatcttcatgtaaatcagcaattacatcacctttggcttgaatataagttgcagtccaagggttacctgtagcatcagtataaaaaagtgccttaccgtggtctgcatagtgaccagctaaaccagcagctttaatttcatctattgatgcattgctcattagttgatataccatggttccaagtatttctacatgggccatttcttctgttcctatgtcagttaatagaccttttgatttgtttgttggcattgtatatctttgatttaaatatctaagtgcagcccctagttccccgtcgggaccaccatattgagttattaaaagttttgccatatttaaatcagagcatttcaaattaacaggatattctaatgtttttacatagtaccacataaacttactcctccttattactttctttttcccaaggccaaggactgtcaatccatacttcaggattttgaatataagaagagccaaagttagttaaaggaccataatcttgctcataatcccaaattaattttcttagcttagaggaaattactttataatcatcagttgcatttttacaattaggaaaattatctaaatatagatttaaatctaaagcaaaaaattgaagttttctaattgcatttaaacattcatgcttattcatattttctcctccttggaatacataattgcacaataaggactataaagatccttaaatattgttccagcatcaaaagctgagtttaaatcaaacaggttttgatagggttgtagaacaatacatgctttagcataagtcataggagaaaaaactttaaatgattcataacagttctttttggtatcagcacaggcaatattacaaccaacatcagatgtatttttaatacaatcatcgcagtttatacatttatctattctttgatagtacataatagtgtatcccttcgtaaaaattatctacaatacactttatgtataagcaaaaaaaatgtgaggaaatattgtcgaattaaattattttactttctttatgaccacaataatcacacttaaaataaatctttccatgcaccttattatcatacgcatattcatattcatgcattgattcaccacaaacagggcaagtaagtgttaaatttttatttgaaatattttttttcataaattttactcctttaagtgaaattcaaaatcttcgattttgttaattgaacttgcttgaaactccaaattttaatttggttaagctgaaagtacactttagtgtactcatctgattttatatgaagatgagtttcctttaattattatataactatttataatattcaataataaagaataaaatgtagacagaaagatatataactcaacaaaacattactttatttgcaaaagaataaaaaaggagtaaaatataaaaatgcaatagataaatattaacataagataaaatttaataagaaatgatagataaaatggagcgtaagtttaatatttttgaaactatgacattagtaacaacagtatattatttaggaaaatttttaagagctaaaataaagtttttatcaaagtattgtataacagctcctgttgttggagggctcatttttgcaatagtaatgttaatattaaaagtaactaatatagcaactataatgttagacacaacattacaaaatttatttatgatagcttttttcgctagtgttgactttacagcaagttttaaggttttaaaaagtgggggattaaggttgctgtgtttttagcgttagcaatacttttagtaatttctcagtaaattatcctttgtcagttgtagcaggtattgttataatatagtaataatataattgaaaagtaggtgactataatgtataaaaaacaaatagaagaatattttaacttgcataaagatgagatgctagaagatatatgcaaggtaataagaataaaaagtgatagacaagagccgaaagaaggaatgccttttggtgaaggtgtagtaaaggttttaaatgaggcattagatattgctagcaatatgggatttgaaactaataattatgataattatgttggaacagtagattttaatgataaagaaaaggcattagatattttagcacatcttgatgtagttccagctggagatgaatggacagttacagggccttatgagcctattataaaggatggaaaattgtatggaagaggttctgcggatgataagggaccagcaatagtagcattatatgctttaaaggcagttaaagatttaaatataccattaaataagaatgttagacttatattaggaactgatgaagaatgcggaagtgctgatattgagtattattataaaatagaaaaagaagcacctatgactttttcaccagatgctgactttccagttattaatgttgaaaaaggtggactaaaggctaactttatatctgatttcaaggaagatacaacaatgcctagaattatatcagtaaattcaggagttaaggtaaatgttattccagataaggcaacagcagtaattgaaggaatagataagagtgaagttgagaaatattgtgatacagtaacaaataaaattggagtaaaatttactgttaatgaagaaaataataaatgtattattgaagctaaaggaaaaggtgctcatgcagcttatccagaaggtggtaacaatgcattaactggaattttaacattattatcttcaatgccatttgctgatagtgaaggatttaaaaaattatgtgaaattaataaattattaccacatggtgactataaaggtgaagctattggagtaaagatggctgatgaagtttcaggagaattaactttatcatttactatttttgagtatactactacaaaattaaaaggaacttttgattgtagagcacctttatgtgcaaatgatgaaaatttaagagatgtagtttctgaaaatttaaggaatgttggagtaattttggaaccatgtaatgtatttgaaggacattatgttgatgaaaattctgattttgttcaaacattattaagatgttacgaaatgtatagtgggaaaaaaggtgaatgtatagcaattggtggagggacttatgtccatcacataaaaaatggtgttgcatttggatgtacaatgcctggaactgataataatatgcatggaaatgatgaatttgcagttatagatgagcttatacttagcgctaaaatatttacacaagcaataatagaattatgtaaataatataataatttatatagagggagataaaaatatgcaagcatatgaaagattaataaaatacgcaaaaatttatacaacgtctgatcctaaatcagaaactacaccgtcaactaagagacaatttgatttagctaatattttagttgaagaaatgaaggaaataggaattcaagaagttagagtagatgaaaattgctatgtttatggagttattcctgcaagcaaaggttatgaagataaatatagtatagggttaatagctcatatggatactgcacctgcagcaccaggagaaaatgtaaatccacaattagttgaaaattataatggagaagatttaactcttttaaatggaactgttttatcagtagaaaaatttccacatttgaagaacttaaaagggagaactttaattacaacagatggtaatactcttttaggagctgatgataaagcgggtatagctgaaatattaacagcttgtgaaagaataataaaagaaaatattcctcatggtaagatatgtattggatttacaccagatgaagaaataggaagaggagctaataaatttgatgtaaagaattttggagcacaatttgcttatacaatggacggtggagttgaaggtgaaatttcttatgaaaactttaatgcttcagcagctacagttgagatacatggtgtttcagttcatccaggatcagcaaagaatacaatgattaatgcaacaaatgttggtatcgagtttgatagaatgttacctcaaggtgaaaagccagaatatactgaaggatatgaaggattctattatttagaaagctttagaggaaatacagatcatgctgtattaggatatatattaagagatcatgatgcttgcaaacttgaatctaagaaatctacattacagctaattgaaaagttattaaacgaaaaatatggagaaggtactgttaagttaacaattactgatcaatataagaatatggctgaacatgttaagccatgcatgcatttacttgataatgcaatagctgcaatgaagagtttaaatgttactccagtaattgaacctataagaggtggaacagatggagcaactcttagctatatgggattaccttgtcctaacttaggaactggtggatatgcattccatggtgaatatgagcatattactgtagaaggtatggaaattgcaactaatataataattgaaatattaaagaagtatgcacaataattttatataaaacttacattagataagcagagtgaatattatgactctgcttatttttaatattatgtatatatattaaaaaatgaagatgaaaactttaaaatataaaaaagtatttattttgggggaagaggtgaggaagtatggagaaaattattgtggtaggatgtggtggtgcaggaaaatcaacattttctagagaactatctaataaattagatataccagtatatcatttagataaattattttggaatgaaggatggattgaaactccgaaggcagaatttaataaaaaaattgaaaaagtgataaacaaagataaatggataatagatggaaattatattagaacaattgatataagagcaaagaaggcagatacaataatttttattaatatgccaacatatatttgtctttatagaatttttaagagacgatttatgtataggggaaaaagcagaccagatatggcggaagggtgtccagaaggaattgacatagagttttttaagtgggtattgagttataataaaaaaattagaccagaaatacttaaaaagctaagtttatataaggaaaaagatatcataattttaaatgggaagaaagaagtaaggaagtttttagagggataaatattttgcttagaatgtgtttctttaaactttaaaatggagaaatagttttaataatactaaataattcattatatagaaatatttctgttaataaaagaaaaagatagaatttaaaaggtaacttaactaagtaataaaatttaatgagttttaaggaaaaacaagcaaattcaatatttgagaaaactaattaagagtattaatatttaattaagtaattacttaattaaattagaggtgcttatgaacgagaagattaagatatttaaagctataggtgatgaaacaagagtaaaaattctacttttattatcaaatagaaatatttgcgcaaagggaattgctaagcatttagagatttctgaagccgcagtatctcagcatattaagattttaaaagaagctaatataataattgcatataagcaaggatattatgttatgtatgaattaaatgagaaagtattagcggaagctataggtttcataaatcttcttattcataaaaatactgatttaatttcaaatgagtacaattttaatattgaagaggtaaatactgataggtgtaagcatggatgcaaatccatgaagggttgttgtaaaaacaaaattaaggaggaataaaaatgaaagtatgttttccagttaactctaatgaaggtttaaatagtatgccatataatcactttggaagcgctccagaatttgttgtatgggatggggaaagtaatgtagttaaatcaattagtaatggtgatttagggcatgagcacggaaagtgtaatcctattaaagcattatcaggagaagtagttgatgctgtagttgtaggaggaataggtaaaggtgccattgttaaattaaactctatgggaataaaggtatatgaagctattgaaggaacaatatcagataatattaattcacttaagaatggtgtattaaaagaatttgatagtaatcatacatgtaatcatgatggatgctctcatcatggtaataaataaaaaaatatatatatataacgaaaaagcatcattaacttgatgcttttttatgtatataaccttttgattggtaaaaaaaggaatggaaagaacatactttcactttgggtaaatttgtagtaaaattaaatgatacgatagtatattttgtacaaaggatggaaaattaatgagcggaaaagagcatatgattgtagggactactgcaacagcaacaatgggaattggtttcttagtaacaaaaacatttgatagtgtaatttacttagtaccattaataattgggggatttataggatcgtatatgccagatatagattctcataattcaaaagtaagacaagcgtttaataaaatattaacttttttaataatagcaatctttattggatatgttttggggattatgttaaatgtaaatgatattattgtatttttacaaagcaattttaataattattttggtgctattatgttttgtatagtaacaatactaggaaagttatcgcctcatagaatgttcacacataaatggttaggaacattatcattttgtggctgtgtttactttataggaaatatttatttaacattaggctttacaatgggatatatattacatatagtttgtgatagattttcgcctagggggaaaaacctgaaattttttgagtttaagttaccctgcagaaattcaaaaaacaaaactacaattgtttggtaaaaatgaagtttcagcaagaacaatgtatatgcctatttaataataagaaaattattgatacaattataagtaaaaagagagatgaaaataacattatttaataaacaatattgaggtgaaataatgattaactatgattatggaagattaactggtgaagttattactagggaagattttgaatatgaagaagaaagaaaagcttggaatagggctatagaaaagtatccactaattattgtatattgtaaaacagaagaggatatcagaaatgcaattatatttgctaaggctaactcactttcaataagaataagaaatgggcgtcatcattatgaaggatattctacaggaaatgatgtagtagttattgatgtaagtaaaatgaataaaatatacatagatgaagaaaatgaaaaagtaaagattcaagcaggagtaagaaatagggaattgtatgaagctactgggaaaaaaggatatccatttcctggtggaggatgccctacagtaagtgcagttggattcactttaggtggaggttggggatactctgcaaggcttttaggacttggatgcgatagattagttgaagttgaattaatagattgcaatgggaaaactataatttgcaataaggaaataaatgaagatttgttttgggcattaaggggctgtggtggaggtaattttggtgtagttacttctatgacttataatttaccacctagaattgatatggttacattggttaatatagattttacacatatagattttgaagaaaatattgatttgattgaaaaatggcaagagatttataaggttatggataagagagctaattttaagttagcttgttataattcaagtgatagaggtaaaggtgttaagatagttggattagtatatggagataaaaagctgacaaatgaaatactaaagccgattaaagatattgtatctcaagggagttataaacttgattatatagatatttttgaagcaaataaaataattcaagatagtcatccagaatttgaaagatataaaagtgcaggtagatttgtttataaggattatactagggaagaaattactaaacttttagaattaattgatgaaagagcggaaggggctacttatacagcaataactttttatggattaggtggagtaataaaggaagttaaaagtgatagtacagctttctatcatagagatgcacagtttatcttagggttccaatcagtttgggaagaacctaggtttgcaccagtaaatagaaaatggtttgtagaaaaattagagtacataaaatttataacagatggtggatttgttaatttcccatgtcaggagataaatagtcaatcaaaaagttatgaagaggaatattatggggaaaattcagagttgttaaaattaataaaagaaaaatatgataaagatgatttctttaattttgaacaagatattagaatagagagaaaattattttatgatttccttgttagataatatttagaaggttattattaagataataaaaataacagtagagatagtatattactctactgttatttgttattttctttaaaagaataaagattagattattaatataaaaatactacttagcaatcggaattgctttcatctacagtaggtgcttctattaaagtagcaaagatatattcatgacgatgtccatctacagttgtagtatagccttttactagatgaacatgttttccatttcctacatatattgcagggcctgtagtattacagattttatgatgatgatctacaaaatctgtattagtggctagcttatgaacatgtgatctaccatattttatagcttcaccagtaactccagcaaaacgatggttgtgtctatcatcgcattcttcagcaaacattgttgaaccttcaaattcatgaacatgatcatctaaagtattttctgaataatcatcactttcacaattagaatatctacatttattatatctagtactcataaaaattattcctcctcatttgttgttataatatataatatgacgatcctaaaaaagttgacataaatttttattgaaaatatattaatttattgaatttctccagtaatttaaaaaaatgataatatcttttaaagatggacttttagcatttcttacataataaccagaagttgcagttcctaaaactagtgacagttgagtagaaagtcctaatacttgtccaaagcagaagccagcattaaaattatctccagcacctgtagttaatttgggatttggttcgtaaggcccaggagtataatagtattttccgttacatactgcacatgcttcctttacaggatgaattactagtgtatgaatacttaaccttttagaaagttctattgtaagagtttttaaaggaactttattttctgatgaggttattccgaaaatttctccaatttcataggcttctttttcattcaatcctaaaataacattaaatttagatgaaaattcttttaataatgataaagcttctaaaacatcagattttaatctgttttcgggatcagctaaatcgaagaaaatatacttattatcttttttatttagattaggaagtacttcattaattaaacctttccatatttgagtcatataaggaagcatagtccagttctctaatccaactaaagttgaactatcaataatagaggttaacttttcaactccgactttttctttgatcttattccaatttacatcttttaagcattcacgttttccaatcataagttttccgtctaaaaattcaactgcatctgtaagaccaggatttgaaatagaaattatattacattttttagacatttcactgaagactggattaatggaattttcaccaagagcacctatataatttatatttaagccataggtggccaaagcattgctcataataggtccattaccaccaagtttgctttgaagaggaataaattcaacatttgagcttagtccggcagctttactgataaaatcaccgaattcacttaatgtttccattctaatatagttatttgcatcagttcttgttttgactacatgaagaatttgatcaacaaatccgtctaatcccattaatgcattaatatttatattattatgttgctctagaaatgcaattaaagagttaaggtcattttttaaatttttatccaattaaacttcctccaatcaataaaaataatatctttaaaagctggtaataaataacgtaaaatttaatttcataatatatatatagtgatttaaaaaaattatgttagtattctttattttgataaaatgatataatataagttaaatgaaattagtgcaaaagagaaaaagaagttaggatttagattaaggaatggtaaaacatgcaggagagaatagactacaaaaaaatagattttaattcagcaagagatgtattaggtggtaagaatgttgtttttacagggagaggatttttagtaagaggagaacttatgagacttgcgaggcaggctggagcaaatgtagatactatagtaacaaaaaagtgtgatattttaattgttggggaaaaaccaggtagcaagctaagaaaagcaaaaattttagggtgtgaaataattactacaaatgatttcaaagatattttagaaggcaaaataagtaaagtagaaaatgatattgatgaagatatattaaatataaatagtaatgataatattaatgaaggtatatatattttaagaaaaaatatattattgcttataaataatgaagctattaaaatgaaaactattagaaatataaaattaaatggtggaaatattatagataattttgataaagaaaaggttgatttaatagtttatcagccaaactctaaaattgctaatattttagataaagctaaaaaggataatataaatacaattagtttaggggtttttaataaaatgcttatgagttgattaataaaataatttggggaggaaaataagttgaataataagagggatggacatgtacacagttattattgtccacatggaagtaatgataggtttgaagcgtatttaaggaaggcaatagaattaggaatagaagaaattacatttacagagcatatgactatgccagaggatttaactttagatggagtagatagggaatatttaaattcttctgctccaaatatagaagagatgaaaaagtacttaaaagaagtaagtaattataaagaagaatataaaaataaaattaaaataaacattgggttagaagtagattatttagagggatatgaagaatttacaactgctatgcttaatgaatatggaaggtatttagacgatgcacttatatctattcatataggaatgtatgaggggaagtattatgcatttgattgtattgagtcatttgaagcattactaaataaaatcgggggtgtagaaaaaatatacaatttatattataataccttattgaagggaataaaaagtaatttaggaaattacaagcctaaaaggattggacatcctacattaattagaatatttaataagttatatcctattgactataaaaatgataaattatttgaagaaataattaaggaagtcaaattaagaaattatgaattggactataatacagctggattaagaaaacagtattgtggagaaatatatccaagtggtgatttgtatgatttagcgataaaaaataatatacaaatggtttatggatctgattctcatgaagctaaggatgttggatttaacttcaaataatataattggaggaagagatatgggaagcataaggttaaaaaaaataattgcagttgccatgatatttgttatggggtcatcagtttatggatgtacaagtacaaatgcttctggtagccaaaatgataatattgtagttgaagattcaaacaataacaatagtggtaataatgatattgtggttgaagatgatgaaaatgagcaacaaataagcaatacagaagaaaattatgatgatgaatctaagatagagttgtttaaattatactctaaggatgcagagcagggagcagaaatttatttaggtgaagttgagattgatgaaaatgaatcattagaaaataaattagcacaaattgcaactgtattaagtgaagaagcttttgacaacttaccaatatcaattactgaaatcaaagacgtagatggaaagaagattgcggtatttaatttagatgaaataggtaacaatgcaggtgatgttcaattttcagattatgaaggtataagttggtataataatttctttgcaggatcaacaggtggagatataactcaatatactttaataagaaacttattacaaagagattatacaggtgaatggattgatggtgtagagtttacatacaaaggttctaaaattgagtttgatcatgttccagacttaggagaaattacttacagatagataatattctaaattaaaattttaaaggttgtatcataattgatgcaacctttattttacatgatataaactattttaaatagttgcttttattatataatttaagtaaaataagttttgttattaaaaatatgaggtgataaatatgagtggtatagcaggtaatgggtgcgcaagaatagtaccagaagaagctaaaaagactcttgaagaaatagaaagaagtattgttaaaagatatagaaagccaatatggtcgaaatttataaaagcagttaaggattatcaattaatagaagaaggcgataagatagcggttgcaatttccggtggcaaagactcactactaatggcaaagttatttcaagaattaaaaaaacatggtcaagtaaattttgatgtagaatttatagcaatggatccaggatatcatccacaaataaaagatttactaatagaaaactgtgagcatttaaacattccagtacatatttatgaatcgaaaatttttgaaataattgatgaaaaagcaaaagactatccatgttacctttgtgcaagaatgagaagaggatcattatataataaggctagagaattaggatgtaataagcttgcattaggacatcactataatgatgtaattgaaacaactatgctaaatgttctttatgcaggaaactttaaaacaatgttacctaaattaaaggctgataactttgaaggaattgaacttataagaccactttattatgtagaagaggaagcaattataagatttattaagtatacaggattatggccacttaattgtgcttgtatggttgctgcagaaaaaattgggaataagagacacgaaattaaagatatgatagcagaattaaagaaaaactttaatgatgttgacaaatctatatttaaggctgcagcaaatgttaatatgaattctattttaggatgggaaaaagatggagaaaaatattcatttttagatccagaaaacccaaagaaataaattaataaagcagaataaaacagggtaggttgctaatactaaatatataatatttagtggaggtgttgttatggctaagaaaggtcaagaagccacttgggaaaatgatcattttaaaggggcaaagaaaccaagagcagcaaaagtaccagaagtaaatccagttggaaatggaaaatagcataaatttttatataaagtaaatataaacttaattctaaccttaaggtgaagttttaactctactttaaggttagaattggttatacaaaaagtgcacttagtttagtggtatctattagtattaccacctaaaaagaacaagtattatgacggttagcaattagataaataaaaaaataagctaaagtactaaaaaggtatgtactttagcttattttcatataaaatataagagtggggaaaatttggataatgtataattgaaataacatatttagattatggaggtaaaaatggataaagaaacactaatgaaaatggatcctaatatactagtaagtatggttaatatgaagttaagagattattattcaagtttagaccagtattgtgacgatattgggcttgaaagagaatatattgaaaagagacttggaagtattggatataaatattgttcagatattaatcagttcaaataatttattaagtaataatattaatgggtagatagaaaatttaaaaagaggtgaagaatatgaaattaaaaaaaataggaaaaattgcggtggttattgctgcgtcaacagcattggttactactttaattaatgacaggaaaaataaagaacgtacaagtaatgactagtaatacatttactaagatatgtaaaataggggtaataatatgaatataatcaaggggaaagaggttgcaaaaagaaatatatcatcaactatagagaaataatatggagcgattatttttattgatataaaaaatgaaaaagttagtttatgtggcaacttagaaagtatattccagatgaaatgtaataatcttgatatttcaataaataaattttgtgattatattcatgaaaagcatgttgaaaaatttctttgtttatttaacgaagataatttaactaaaaataattttaagttacagataaaaaatcattgccctgaaaaagttaagtggattaaaattcatttaaataaagtagtaattgaaaatgaagttataggatatgaaggatacgttagtgagatagttgatttaaatggagatgaaagtgaagtagcatttttagaaaacataccatatttggatgaagttacaggattacataaaagaatttatttaaaggataaattagatgtttatttagaaataaataaaaactctgataataaaggtgcattaattatattaggattagataattttaaatatataaatgatacttttggagttacatatggagataaatacctaaaatcagttactaaagagcttaaaaataagcttatcagtgatgattatatttgtaaacttgaaggtgatgagtttttaatatttttacataatgctacaacgttaagggagattgaaactaaagcacaatttattatagatgtttttaataaatcgtataacatagaaggaaagcaagtgcatgttacaactagtataggagtagcaatttatccagatgatggatatgattttgatgagttaataaaaaatgcagatgcagcaatgtatgaagcaaaaacaaaggggaacaatcagtatcaattttttaatgatagtattgcacaagccatggatagggcatataaaatacaaaataatttaatgagtgcaattgaaaatgaagaaatgtatgttgtatttcaaccaaaagtaattttagctcatgagaaagtaaatggatttgaagcactaattagatggaataataaggagattggaaatgtgcctccaagtgagttaattccagttgttgaaaataatggaatgatagtacctttaggaaattttgttttatgggaagtttttaagaaaattgatttactattaaaatcagggtattcaaattttaaaattgcagtaaacttatcagatatgtaactgagagaccgagagttaataaattatgttaaatacttatgtgatatttataagattgatggtaggtatattgagtttgaaataactgaagggatattaatcaaatcctatgaagatacattaagatctttatatgatttaaaaaaacttggtgcaaccatagcattagatgactttggtacaggatattcatcattaaactatttaactaagcttccaattgatgcattgaagattgataggagttttgttattgatatggtagaaaatcataaaagtagatggattgtagaaaatataatccaattatctcataaattaggtatagaagttgtagctgaaggagtagaacttgaagagcaagttgattatttaaaatcaattttatgtgatattgttcaaggatatttttatagcaaacctgagacatttgagaaagtggtagatttattagaaaaataattagataattattaggtaaataaaataggagtgataaaatttttattacttctattttattgtgaaaaaatatagaaggagaaagatacatgaagagaaaagttgatttagtttcagggaatataataaaaacattaatagcgttatctttaccaatattggggacatcgtttattcaaatggcatatagtttagtagatatgatatggattggaaaagccggaagtgccgctgttgctgctgttgggacagctggtttttttgcatggtttggaaattccttagttttaataacgaagactggtgccgaagttggagtgtcacaagctataggtaaaaatgatgaaaaggagagaaattcatatgtatatagcagtatagcattatgtgttgtaatgtcaattatatatggaattattttaattttatttaggaatgaacttataggtttctttaatttaggcgattcaaatataataaagatgtctttagaatatttaattattattgcattaggaatgatatgtgcttttttaaatccacagctaacagggatatttactgcttcaggaaatagtaaaactccatttgtagtaaatactataggactagtaatgaatatagttttagatccaattttaatatttggatttgctgggattaagccattgggtgtagtaggtgcagctttggcaacagtattatcacaacttctagttactattatatttatatatacatttattaaaaatggatataactttagttttagtaataagaaatttattactttagagtatataaaaaatatatgtatatttggagggccaacagcaattcaaaattgtttatttacatttttctcaatgctccttggaagaattgtagctagtgcaggaccagtttcaatagcagttcaaaaagttggatcacaaatagaatctatttcgtggatgactgctggaggatttgcaagtgcattaaccgcatttattggacaaaactatggagctaagaaatgggatagggtattaaatggatataaggttacactatttatttcttgtttattaggagtatttaccacaatattattagtgttctttggtgggggtattttttcaatatttataaatgaaggtgaagcaatagctcaaggaattgattatttgaaaattttaggctattctcaattgtttatgtgtttggaaataacaacatcaggagcattttatggagttggaaaaactgttactccatcaataataagtattatttttactggtttaagggtacctttggctataattttatttagaccagagattttagggataaatggagtatggtggagtattagtggaacaagcatagtaaaaggaatattacttgtagtgctgttttcattaatagtaataagaccactaaaaaaacaaataagcatagaagtttaaaataatcaaaaaaaggctcatgttaaaatattagaagtaacatgagctttttatttattatttttttagtacatgataaatttcaggagtatccatagttattttttcgaatgtatatccttgactcttataatatttaattatactttttattgctatggcagtatttttgtttgcatatgcattatgcattaaaactacaacattgtctttggtagatatggacctatttaaaatagtatccggagatgaatttgggtttgctccgtctaaagtatcttgagtccaatcatatattttaaatccattagaatgaactgcatttaccatttcgttggatagtctataggtactattatttgttccataagggaatcttaaaatacagtaattttcaccagtaacatcataaagagacttttgaacttgtttcatttctgaaatgaaaccatcacagctactatacagtttacttctttcatgagtaaagctatgtaggccgatactatgaccttcttctttcattctaagaattatatcctcctgtccttttatctgattgcctattataaaaaaggtagcaggaacattttcttctttcaatacatctaaggtttttgtagttacctctccaccaggagaatcatcaaaggttaaataaacaacctttttattagtgttttctctattgtcatcatcacaatatgtgattgattgaggaaagagaagaaaaacggcaaaaataaataaagttaaattaaatagttttttcatcatataaaaatcactcttttcgctataaaattaataagttcctctagattagagtcatttttagtatgtacaatttgaaaaaatatatttcttgatattttatataaaagagtatataataacaaaaaggctttaagtcgaatcagagagttcggtaagtttcaaaagtttgtagtattaataattttaatagaattactatagcttcttactgaatgtaagaagctttttttttacctttaataacagtccagtgaggctgaaaagggggaattttaaattctccttaaaagaaaatagggagggtgttttatgacacaatatacaggtgaattattaaaagaaagtagaagcgttaaagatggggcaatgaaagttattcttgcaatgcagcatctaatagcaatgtttggggcaacagtactagtaccaatattaactggattagatccatcggtagcattattttcagctggtgttggaacattgatattccatttatgtacaaaagggaaggttccagtatttttaggatcatcatttgcatttattccagtaatagtagcagtaggagaaaaatataatggtgatttaagatatgctcaaggtggtattattgtagttggattgatttatgtagcagtatcctttttaataaaaaggataggattaaagaatattaaaaaagtattaccagctcaagtagtagggccaatgataatagtaattggtttaaacttaattccaacagcattagatatgacaggaataacagctatagcttcaggaggaaatgatgctgtagtaagtgtaataatagcttgtataacattaggaatagcattgttaattaaaaagtttagtaaaggattcttatcacaagtatctattttaatagctgtagtagtaggatatgtaattagctcaatgtttggattggtatctacagcagaaattcaaagtgcaagtttagtggctataccaagttttacattacctaaatttgatattgctgcaatggcaataatagcaccagtggtattagctgtagtaatggaacatgtaggtgatattactacaaatggagaagttgtaggtaaaaattttatagaagatccaggtttaaatagaacgttattaggagatggacttgcaacgttagcagctggatttttaggtggaccagcaaatacaacatatggtgaaaatacaggagtgctagcaataacaaaaaattataatccagcaatattaagattaacagctgtttttgcaatattattaagctttgttgcgaagtttggagctgcaataagaacaataccacaaccggtaatgggtggaataagtttaatgttattttcaatgatagcgattgttggagttaagacaattaaaagagaaaaagttgaattcaatatttgcaatattgttgtaatgctagcaatattaattatagggctttcaggaaacttcttagaaaatgcaataggaatacaaataactgaaacagtaagtatatcaggattaagttttgctgcaattataggggttttacttaatgtaaaatttacaaaattaaaaaaagcaaaataattaaaaatattaattaatataacactaaataatagaaatattatttagtgttaatttattttaatgaaaaaatacagaatgtattaataaatttagtagaaacatatatatagttttataactatatgataaaattagtttatgaatatatattttggaggttatgatgaacctaaatattaaaagtaataaaaagttatataaatataataaattttttatagtatttgtaggaataattatatttcttttagtacaatataaattaatagatttatcacaagttataatgataatagtaatagctattttaatgcttatgcttgaagagtgtttcataagaattaaaatgaaaaataacgagtgtattaagtgtaaagaaggatatgctttatctattgaagcaatggatggagcaatttggaaatgggatgatgatacaaatagtttgtttatttcaggaaagataaagaatcaacttgggataaggaaagagaatattacgttagaagactggtatggatatgtagatgattcccaatatgataaagtaaggacttattttaataatatatgcttaaatagaatgtgtatagaatcaaatattaagtatagactaaaggcaaaagatggacagttaattcatgttgattatacaggaaagggttctataaaagataagatttatagtttatctggagtaataaccgatgttagtaaggaaaaaaaagctgaacaaaagattcattttatgaattattatgatgatataacaggtatccctaacaggaaaatgtttacagaaaaatttaaagagttaattaacgataatcttagttgtggtacaaagttaggattaattttttatgatatagataattttaaaagtattaatgatacttatggtcatgaagtaggagatcagatacttttaaagctttctgagagagtgaataaagaactagatggaagacatacatttgctagatttggtggagatgaatttgtaattgctttttctagagtaaatgatgaaaatgaaataagagaattattaaatagattgttagttagcgtgagaaaacctattgaagttaataataaaaatatatattgttccataagtttaggggtaagtatgtatccaagagatgcaaaaaatctagatatactattgaaaacagcagatatggcaatgcataaggctaaagaagaagggaaaaatagatttagattttttgatgttgatattttaactttgttaaggcgacaatatgatattgaaaaggcctttagaactgctattgaaaaggaagaaatatttatggtttttcaaccaaaaatatcgataaaaggtgaaaaagtaaatggatttgaagctttagtaagatgggtaagccaagagttgggatttgtttctccagctgaatttattccaattgctgaaaatacaggatttattgttgaactagggaagtatattgttgaagaaagttttaaaaagtgcagagagttatatgagacaagtgatcataaatttcatatagctattaacatatcggatattcaattgagagaagagggctttatagaatttatttcagatttacttaataaatataatgtaccaccggaatatatagagtttgaaattactgaaggagttattatgcagtcagtatcaagaaatatagagattttattgaatttaaaaaatttaggtgtatctattgcgcttgacgattttggaacagggtattcatcattaagctatttaaaaagactaccaatagatgtattaaagattgataaaagctttgtagatggtattggagttgacgagaaaagtgagtatatagcagaaagcataataaagctttcacatagtttagatttaaaagtagttgctgaaggagtagaaactaaggagcaattaggatatttagataaaatgaagtgtgatatcgcacaaggatattattttagcaaaccagaaaaatttgaaattataaaagaaatgatataaaatttttaatttttaagcacaaaatgacctcttaatgcgtattatgtaaatatacgattttaggaggtttttatgcgtataagaatagaggatgattttgatggtgaactagaaaatgaatataagtcaatagataatgactcaaatgtaggaaatggtaaattatcaaattctagtgaaacaataatagatgtcgaagcaactgatgttgaagtagataaagctactaatgatgatagttgtaatgaaaatatagatggcccaatagcttcagaaaaggataaaaaggaagcaaagacttataaccttgataatggattcagtttagaacttcaaggtgcaacttttatagatgataatgaagaagtaaatgataataggggttatattaatcaaaaagtagtaacggatgatgaaaatgaatataataatgaaagtgagtacaataatgaaagtgagtacaataatgaaaagataacagcagatgataaagatgagtacgataatgaaacaatagcaacaggttataatagtgattatattaataaaaaaataaaaatagatgataatgtaaaagaaaagtttgtagaaaatgaaggatttgaacaagagtatataaataatagtaattataaaaaaataaaaaagaaagaaaggaaaatagttggaaagattacggttatatcaaagttaggagatagaaaaggaagttgtatttcagatgctaagataaatttatatgctctaaatggattatctccaaagctgataagttcaaaatttacggataaaaatggagttgttatctttgataatttagctgaaggaagttatagagtaattgaaattgtaaataggaagtattttgaaaaaccaacatatattcaatggaatgaagtaactattgatgatgaattaagggaagaaagtattatagtaataaataaagtaaaacgtcattaaagataatacagaaggattgaggattagtgaaatattagtttaaagatattatacttttcttacaatccttttttatgttagaattacatataataaatgaaaggaagatacgagaaatgaaaataaagataaagtattttgaaggcgcaacaaagttaaagaagattagtaagggaaattggatagatgtttatgctagtaaagatatatttgtgcctttaaatgaaagagcgatgataccactaggatttgctttagaattaccacaaggatgggaagggcatttagcaccaagaagttcaacgtttaaaacttggggaataatacaaacaaattctgttggagtcgttgatgatacatatattggagataatgatcaatggcacatgcctgtatactgcttgcaagcaaaacatgatagtggaacatggataagaactggagataaaatagggcagtttagaataatggaagtaatgccagaaattgaatttgatgaggttgaagctttcggtaattgtgatcgtggaggatttggaactacaggaagaaactaaagcatttattgaaagtcagtataaaaactgactttttgtttaaaatataaatataaggaaacaatgaaaaaattattgtaattatatgtaaattatgttaatataaacaaaagaggggttattacaatcaaagggagaagtagggaagacatgaagtacattgatttatcacatgaaataaaaaatgaaatgcctgtttatccaggagataaaggtgttaaattaataaaagaaaaagattatgtagagaatggatataatagtttttctatagttacagaaatgcatgcaggaacacatatagatgcaccgctacatatgaaagaaaataaaaactatatagctgactatccaattgaaaagtttgtaggtaatgtagtattattggatgttagaggggagaagcttatagaggttaaggaggaatactatataaatattaaagaaaatgatatagtattattatttactgggtgggataacttttatggaaaagaagagtattatactgatcatccaattgtaagtatggagttagcagagcttttaataaaaaagaaaattaagatgttaggaatggatatgccttcaccagatagggataattatgaaatccataatatattatttgaaaatgatatatttcttttggagaacttaactaatttaaataaacttttatataatgagaatattcaattatttgcccaacctttaaaggttcaaagtgaggcgagtttagttagggctgtagcaatttatcagggatattaatattatagataaaaataacagaatacatttagtactctgttatttttatttataagaaaatattatatacaactagaaataaaactttcaaataatttaagcatgatagtatcttttaatgaaagcatctcgggatgccattggacacctactacaaaatttttaccttccatttcaatagattcaataattccatctggggaagttgaggtagcaataaggttattaccaagttctttaacagcttgatggtgagcgctattaacaatgtatttatcttctcctaatatattacgaattaaactattctttttaatagagattggatgacaaatatttgataaatgactattttgattatgaagtattgcattaggaatattatgagatatatcttgataaagagtaccacctgctgcaacatttaatacttgtatacctctgcatattcctaatatgggcatgtttagagataaagctttttgagttatggaaatttgataccaatctataagatcattacattttccaaggtgaagttgtggagaagtattatataagagtggattgatatcagcaccaccaggtaataatattccattacaaagtgacaattgttcctctaagacatctttgttttcaataataggaagataaatagggattccgttagcctttgcgatgcatttagagtagttattattattataatcgaaataatttccagcaaatgaaggattagattctgtatataaagaacctataataccaataattggtttgatcattttaacctccatgaaatttattgtttataatatataatatagtagaaaagaaagctattgtttactatagtaataaacaaataaatggactattattgcaataatccatttatttattattagataaagtatattaatttaaagttcatcttattataaagtttactgaagactatatatatcagaaaattcaatactgcatttatctaatctactatgactatcttcatttatattatagattatatctgagtccttaattgtttgaattggtaaagtgaaagtgaattctgacccaatattttttatgctataaacggcaattttaccaccatgcatttgaacaagagattgtacaagtgataatcctattccacttccttcacattttctagttaaagtatcatcaacctgtataaatctttcgaaaataatagatatattttctttggggattccaataccagtatctttaacagaaataataacattatcttcagttttatcaataaagacatttattacaccaggtgatttagtatatttaactgcattagaaagaagatttagcataattctttcaattttatcagggtcacatgagataattatctcttcaaaagaggtatcaaaaattaaatctatacccttatcttttagatactgtgctacagatagtgttatatcttcaattatagaaactatgttacaatttttcgggtgtatttcgtaataaccactatctattttagtaatatcaattaaattattagcaagtcgtagaagtctataggagttctgtttaattgaatttgtatatttttttaaattgaaatccttagagcatttaatattttcattaaaagtattatgattaattacttgtaagcttgctaaaattatatttagcggtgttttaaattcatgagatatattagcaaaaaattcattttttatattttctatatgcaaagattcttccataagttttttttcgatttctaattcttttttatcagtaatatcttttcctgtaaccataataacattatcagaatcaatataagaacaattccaattaagccattttacacaaccattcttagtaattaatctaatacataaatcagtaatagttgttatagaatgtaatttgctactaaataaatcataaagtttatatttgtcatcactatgtgttagacttaacaaattcatagataaaagttcttctttagtatagcctaagagtttgatccaaccttcattaatctttaagaaatctccattagcggctatagttgcagttaaatctgttgcagtttttaataaaaaggaaagttctatttcagttttaacacgtttatgtaattctatttttagattgttagataaaagatagttatgcattgacaacccaaagcgattacaaagtgtagatataaattcattattatgaactacaggagtaaacttatccttatatcctatataaattaatcctaaaaatttattattatagtaaattggttgtacacatatttgttttatagtttttctatagtatttgtgaagtttacttggagataaaaaatctatatcgtgcaatccccagtctgtaaaaggtttaataagggtttcgtatttgtagtgtgttagttgaattgaatgaaaattctttacaagctcatcgtaagaggaactacaataaggaattaaagattcattaacatatatccaagcatgaaattcatcacaattcaatgattctaaaatagtattgctaagtctatttaaagatgcaaattcatcagtgcaatctatattttgttttaataaattattaatactatttaattgtatattacttttagctatatccatttcataattattttcaggtgttaaagttaaagggttatatattcttttaaagtttttcatattattctttttataatcatcatcggtaatattatcttcattataacattcgagtttaataaatatactattagtatttttatacaaacctttagaaattttagtattaaatttaattggtaaagaatttttagaaataatatctaagttttttaatgatttatctttaatattaaacaaagtattaatatttttatttaatataaaagataaaatatttttatcaattatctcattaagtttgtaaccaagttgtataagaagagctttatttgaaaatagaattttaccagtatgatctattataagaattttttcatttaaaatattaaaaaagttttccattaatcctccaagattatttaactatgtgtatatttactctaattataatcctattttatcaaataatgtagcaattttgcaaataagtataaaatgcttatttataaataagaataaagtaaaaataaaaaataaataagactttataattatataagttttatttataattatagaataataaaagtattaagttttagagtttacacaaagtaaaataaaagaagaataatataacactggagttggaattaataaaaaatatcatgatttaatatttaatagatttaatcaagttattgatccatcatatgcagttaaaaaggaaggtgggttaggattaactattacaaagaagataattgatcttcataatagtgatatttatgtaaaaagttataccagcacaagtaagtaagtttattatagtattgctagttaagcaaaaaaaggtagtatgttttgaattaagatataaccttattaatgagtaggagattagtaaatgagaaaatttaaaaaagtatatatagaaattactaatgtatgtaatttaagttgtgatttttgcccaaagacaagtagaaaatataaatttatgaatagggaagaatttaactatataattaatgaaataaagccatatacagatcacgtatactttcatttaatgggtgagcctttattaaatgaaaatatagatggattttttgaggaatgctataaaaatggattaatggttaatttgacaactaatggaacattactaaataaaaatttagaaaagcttattaatgcaaaagcattgagacaagtaaatatttcactacatagttttgaagcaaatgaaagtaatatagagctatatgaatatattaatagagttactgattttattaatgaagctagaaaaaagagtgatattatatgtgctataagactttggaatatggataatgaggagttaaagggtgctaataaattgaatttagaaatattgaatttattagagaaaaatcttaatttggacttttcattggcagaaaaattacaagaaacgcataagattaagctaaaagataaagtttatttaaatatggctgaaaaatttaactggccagatattagtataaattctattggtgaagaagtattttgtcatgggcttagaaatcaaataggaatattggttgatggtacagttgttccttgttgtttagatagtgaaggaactattaaattgggaaatgtttttaaagaaccatttataagcattttagaaggagaaagagcatctaatatatataatggattttctagaagagttgcagtggaagatttgtgtaagagatgtggatatgcaacgagatttaaaaaataatttttatttaataagtttgatatagataaatggaattataagtaaaattgtattccataactaaggaggaaaaatggaagagagaaatttgaaaaaagagattagtctttttatggctacaatgcttgtatgtggtaatatgataggttcaggagtatttatgttgccatcaacattagcacaagtatcaggaccaggagcaacaataattgcatggataatgacaactattggttctatattaattgcaatatcctttgctaatcttggaactaagtatccttcaactggaggagcatatcaatacactaaggaagcttttggagactttgcaggatttttaagtgcatggttatactggaatggttcatggataggaaatgcagctattattgtggcaataactagctatgcatcagcagttattcctgctttaaataatccaattatttcaatattattttctagtgctatattgtggatatttacaatagttaatatcttaagtgtaaaagttgcaggaaaacttcaatcatttgtaactgtatttaaaataggattttttacactttttataattgtagcatttttaaattttgataattctaatataatgcctttattctcagaaggcaaaggattaagtacggtaccattagctgcaacatcaacattatgggcatttataggattagaaagtgctacggttgcagcaggagagattaaaaatccagaaaaaaatataagaaaaagtactatttatggattaataattgcggcaataatatatttagcaataagtatagcaagtatgggagccatggataatcaaaccttagcaaacagtactgcaccacttactgatatattaactaatgcattaggaaatggatttgggaagattcttacaattgcggttgttatttgtattttagggactgttattggatggttattagcaactgcaagagtttcttatgctgctggggttgatggggtattccctaaattctttggaaagataaatgagaaaacgggaacacctgtaaactcacttatatttggagctgttttagttaatatattattggtaatgaatttccaaaaaggtatggttgatgcatttacatttataacaatactagcaacactttcatatttacctgtatacatattaagtatttcagcagaaatgatgttaacatttaaagaaaataaagagtttagtttcaaaatatttattaaaaaatctatattaccattattagcatttatatatgtgctatggactatatatggttcaggtgcagaaacagtaatgtggggatttatacttatgcttttaggaataccagtatatgtgtataatcaccataagaatgaagtaagtagataagagaaaaatcagtagcagtttatgttactgatttttttaaaagtaaatatcttacagtaatataattattatattactagaagatatttagaaaatcttaataaataatgatgataaagtatggtaaaataatattactatttagtagggaggataagaaatgaaaattaactggaataataagtatgcaactatttcaatatatgcttttcttgttatttgtggaagtattcttctatatgtaggaatatcgcaaattaatgatataaaggcaggaataagtgattttataggaacattacaaccatttattataggaggagcattagcttatatattaaattttattttaaagttttacgaagaatatgttttatcatataagtggtttcaaaaattaaagaaaaatggtaaaaggggagtaggaatattatttacgtatataacagctactataataagttacttatttattcaatttgtacttcctcaattaattgatagtatagtgggccttgtaaataatataccacagtatttaaatgatgtgactaaacttactaatgaagtagtaggaaatattaatttacaacctgagtatgtagagttaattactagtaagttaggagaagcaattaattattttataagtatagtgagtaatttacttccggtagttggtaactttattgtaggagcaacatcaagtattttaaatattattatcggtataattgtatcaatttatattttaatagataaagaaaagtttatggctttaggtaaaaagatcacttatgcattattttcagaagaaagcgcaaagtttgttttgaagttggcaactaaaagtaatatgacctttagtagatttattggaggtaaaattttagattcagcaattataggagtattaacatttattatattaacaatttttaaaatgccatatgtattattaatttcagttataattggagtaactaatataataccattttttggtccgtttattggtgggattccagcagcaataataattcttttcgtttcaccaatacaagcactatggtttattgtaataatcattgtgattcaacaaattgatggtaatataatagggcctaagattcttggagattctattgggatatctgccttttggatattattctcattattagtagctgcgaaattcatgggatttgtaggaatgataataggggttccattatttgcaatattctattccataataaaagaaataatagaagataagctaagtaaaaaggggttacctgtagaaactgataaatataaataaaaaatgtatagaattttgaaatatgtttatactattataatgtaaagacaagaagggtatataaacagtaaccaataattttattattttgttgttatctttgttttagacctttcatatatggaggaattttatatgtcagacaaaactttaacatgcagagattgcggaaatgaatttgttttcacagaaggagaacaagaattctataaggagaaagggttcgaaaatgaaccaacaagatgtgctgcttgtagaaaagctaagaaacaacaaaataatagaagataattatatcgtattgtttcttaagagtcatagagttatatctatgactcttttaatattaaaataaactatcttgaaaagttagtttattttattgattaaatgatttaattaatactgaattaagagcttgattaatatctttatggttaactaaactaacaagagactcatttaatccttctgcagttcttagaagctcaaatgctctatcacaattgccattttttctttcaattaaagcagaataataataaggctcaataaagtgaacattttcttctattaaataatcaaattcctttttagcttcatcaaatttatcaagtttaaagcaaatttctgcataatttgatttaataatattattgtcagaattaaaatccattgcttctatagtatatttttcagcttcagtgaatctacccgaacatagaagcagtgaggttaaagtttcgtaaatataagtgtttttattattttttattaagttttttaatagtgtaattccttcttcttgagaatttgttttccataaaactatagcctttgttacttcgatatttaatgattcacgtggctttatatttttggaatttaagttttcatcaatatattctctagctaaagaaggttttccatattttaattcacaaattaaataattagaaattataggaccattacaatactttgacatagcagcatctctatagtattctaaagctgtttcataatcctctaatttataagatttcatacctttataaactttaataaagtacctttttgttattattaagtaaattaataataatgataaacatagtaaaattgctaattgtaatcctaaaaatgctgaagatattaaagaaacagcaataatagcaattaatataaaatcttttttatttaaattcttccccatataaacccctccattacattgtataaataagatatattataatattttaggttagatttaatataatagtctattataattatacattatgtaaataatttcacaaggcattaataaaaagttaatatcttgaagaaaatattatagggagtataatattattattaaaaatatagaaaggtaattaagatatgaaagtaatgtcctttaatttaagaagcgattttattttagattttaaaaatagatgggataaaagaaaacatatagcatatgaagttattgataaatatgattgtgatattataggtgtacaagaagtaacaaataaaatgtttgatgatataatagataactttaaaaactatacaatagtaggaagtgcaagaagtaaaaagtatttttctgaaagaaataatttatttgtaaaaaataaaaataagataattaagcataatacattttggctatcaaaaagtccagataaggtaggaagtcaactttggtattcattatatcctagaatatgcactactgcggtagtagaacttgaaaatggagataaggttagagtttataatactcatttagattgttttttacctcaagcaagggattttgggcttaaaaaattagctcagtttattgataaaaatcgtaaagaggaaaagcttcctgtaatagttatgggagattttaatgcaactccaaatagtaaaattattaaaaagtttgcggctggtgaatataatacagatagatttgtagcagttcaagaagcaaagcaagaattgtataaaaagtctactatgagtaaatttaaaggtaaagaaaatggacttcatatagattatatatttgtaagtgaagatttagaaattatggatgtagatatagtaaaatacaataataatggaaactatccatcagatcattatccattaattgcggatataagaataaaaagtgaataagtaaataatccaaaagcaattttattatgaatatacttttaaaatttaaaaaagagtatattcataataaaattgcttttttaaagttaaataaaagttaagtaattttaagatatgtaaataatagatgtttaaagttaataaatgttaaaaaataatattttatgaaaaagttaatatataattctttgttccactagtatcaattatttcagcttatttactaacttataaaagaagaaaattcattgataagctaaattaattttgagttaacactagatataattacgtaatatgattgaagttataatctttactagctaaagacaccttaaaactttgaaagtttttaaggtgttttttttgtataggaaagtataaattttttaaagtcgtaaaggtggtgataccaatgtatttcaagatttaaaactataaaattgataccacgaagtgggcgtggcgatagccactttgttcttatagaaagcaaaatattttaatgtttatgaaataaaaaaataaaaaaataaaatatacttgaaataatatttcgttagtgttaatataataccatagagtgtaaacgtaaacaaagttaatggggaggatttaagatatgaatacaataaaattagaaaatttaacaacagaaagtagaaatagtagttctttaaatatcgataaggtatcaacattagatatggtaaagattattaataatgaagataagaaggttgctttagcagttgagaaggaattagtgaaaattgcagaggctattgatggaatagtaagtggaatgcaaaaaggcggaagattaatttatataggagctggaacatcaggaagacttggtatattagatgcttcagaatgtccacctacatatggtgtatctgaagaattagttcaaggaattatagctggagggactgaggcaatatttagggcaaaagagggagcagaggattctaaggaattagcaattgaagatttaaaatcaaagaatataactgaaaatgatacaatagttggactagctgcatcaggaagaacaccttatgttattggtggattagaatatgcaaacaaaataggagcattaacagtatcaataacgtgtaatgcaaactcagaagtagcgaaggtttcaaaagtatcaatagctccagtagtaggtgcagaggtagttactggttcaacgagaatgaaagctggaactgcacaaaagttagtattaaacatgctatcaacaggaactatgattaagctaggaaaagtatatggaaatttaatggtagatgttagagctactaataaaaagctagttgaaagggcaaaaaaaatagtttgtgaagctacaggagtagatagagaagtatcagaaaaagtattaaaagaaacaaattatgatgttaaactgtcaatattaatgatactgacaggattagacatagatgaggcaaaagaaaaattatcacaaaataaaggctatattgctaaggcaatggaaactatttaaagtgtatagggggagagaaaatgacaaagcaaggaagtattacaaaccaagaaatagctaagaagttggttgaacttgttggaggaaaagaaaatatcaaagcagttgaaaattgtatgactcgttgtagactagagttagttgatttatcgaaggctaagattgaagaaattaagaaagcagagggaactttaggaattgttgaagcaaaaggtcaattacaagttatttatggaccaggtaaggttaataagataacagaggaagttaaaaaaatagtaggggtaaagacagctataggagaagaagctgttaaagctacaaaggcaaaattaaaagaaaaaaatgatacaaaatttaaaaatatacttaaaaagttaggaaatatatttattcctttaataccattatttgtagcatgtggactagtgctcgctgtaaataatatagctggagtttattttggagatgtatataagacaactaatgcagctcagataataggattaataggtaatgcagtatttgcaattttaccaattttagtaggggtaaatgcggctaaagaatttggttctcaaatgccaatgataggtggggcattagggggagtgatatcatcagcaacattagctaatataactgtgtttggtaaagcattgacaccaggacgtggaggaattatttcagttattcttgttgtagcattagctgtgtttatagaaaagcaatgtagaaaatttgtaccagatgttttagatttatttgttactccattagtaacgttaacaatatcagttttagcagctttatttatattacaaccagtaggtggagcaatttcagatgctatgggagtattagtctcaaatacaatagcttctaataatacaatagtttcagttttatccggtgctatatcagggggattattcttacctcttgttatgactggaatgcatcaagcattaacaccaattcatgctgatttaattgcaaatgttggatatacagtattattacctgcattagcagctgctggtatggctcaagttggagctactttagctgttgtaagaaaaactaaaaatgaaagattaaagaaaactgcaaaaaatggattaataccaggatttttaggaataggagaaccacttatttatggtgtaacattacctttaggtaaacctttcttaggggcttgtcttggtgcagctgtaggtggagcagtaatggctttattcaaagttggtgctgttgcattaggagtttcaggattgccattagctttattaattgctgatggaaaaatattagtgttcttaataggggttttagcatcatacgcagcaggatatttctttactagtatattaggatttgaagatccagtagaatagaattatattaaaagggtggtatgctattaataaacatatcacccttaaattatatctagttaaattaggaggaattattatgagtttgggtttttcagtttattttggattagataacactatggaagaaaatgtgaagttgttaaatgaagcgaagaaattaggttttacaagaatatttacatctttacatataccagaagcaaattatgaaatattaaaaaaagaagttaatgaattttttggtatagccaaaggttatgaaatggatataataagtgatatttctccaaatacatttaaatttttagaattagagaatatggatttagagggattaaggaattatggggttaaaactattagaatagactttggatatactccaaaagagatagctaaaatgagtaagaataattgtaatattaaaatacagcttaatgcatcaactgtaactgaagattttcttttagaattagataaatataatccagattataaaaatatagatgcacttcataatttttatccgagaaaggggactggtatatcagaggaatgtatgatagaaaagaataaaattcttaacaaaaggggaattaaaacttgcgcatttgttcaatcaaacaacaggagaagaagtcctcttatggatggcttaccaacattagaagatcacagaggtttagatgtaaggaaagctgcaaatcatttatttgctttaaataatgaatcggtatttataggtgattctttaccaagtataagagagcttaaggatttagctgatttaaatcaagacgccatagaactagatattgaattaaaggtaagggataaggttgtagaaagaattttaggtgaaatattttcatcaagaacagatgaagctagagatgctataagagcagctgaaagtagattaatattgaataatgatattataaatcctataaatactattgataaaaaatatggggatattactattgataatgttgaatataaaagatatatgggtgaattgcaaattttaaaggtaaatcaagtaagtgattacagaaccaatgttgtagcatctgttttacagaataatttttatttattaaaatatataaatggaggtaaaaaattttactttaatattattaacaataataggacgtgagaatatgaatttattgcagtatataagacaaaattatgaaagttttacagagagagaaaaacgtatagcagattatcttcttaataaaaatgatgagattattgagatgtctgcaaaggaaataggagatgtaactaatacttcagcaccaacagtagtaaggttttctaaaaaattaggatttaatagtttaaatgaaatgaagataaaactatctattagtttaactaatgataaaaataaagaggaatttgagtatttagatagggatttgagtactaaaagtataattagtggagttaagcaatcaattcatacaataatagatgaaactgtaaatttaataaatgaatgtgaattagataaggctattgatttattaagtaaagctaaaaatatttatgtttttagtgtaggggtatcaaatttggttggattagatttatattataagatgagcagaataaataaaagatgtattgctcattctgatacacaccttcaaattacttcttcagctttgatggaagaaggagatgttgcagttgctatttcatattccggagatacaaaagaggtaatattatgtgctgaaaatgcaaagaaaaataatatacctttaattgtaattacaaaagctagtataaataatagtttagaagaatattctgatgtaacattgcatgtaccttttgttgaaaaatcattaagagaaggtgctatgacttcaagaatttcacaattagctattatagatatgctattcttagggatagcacgaagtaatataaaagatgtggaagaaaagcttttagtaacaagagatgcagtgaaaaaaataaagatataggaatatagatgtattaaaactaatactaatgttaatggttcataaatgaattactaatattaatattagttttttttgtcttaaattttaacaagatgtaaacttttgattaatagaattttatagaaagagaagaaatggggcaaataaacgcttgaaaaaagtggaaatgaaaattgcagtaaaagaaaggaatttaaagaaatagtagtgacaatatatggtaaacacaataaaacattttaaattggataaaaaagtaatgaaactgaaattgaaaaaatagtttaaagggtataaagtttaaggcaaagaacgataaggggggaacagtgtggaaaaaatttcaagagtgatagccaaaagtagagttttgattttaatagttgcaatatttctattaattccttctgcaataggttattttaatacaaaagttaattatgatattttaagctatttacctgatgatttagaaactagagaagctcaaaaaattatgaaggatgaatttgattgtggatctttagctatgttaatagttgaagggatggaaaataaggatgtggctaaacttaaagaaaaagtatctaatgtagatggagtatcagaggtaatttggattgatgatgtacttgatatttctgttcctaaggagatattaccagattccataaggaatatgcttttttcagatgactcgacattaatgattgttaagttaaaagatacagatgctagtgaaagtactgaaaaagcaatagaggaaataagaaatataacaggtaaacaagcttttttaagtgggatagggggagtaataaaagatacaaaagatttagctgataaggaaacaccaatttatattttaatagcagtaattttatcaataataattttaagtttaactatggaatcctttattattccgattatatttatgttaagtataggaattgcagtagtttataatatgggatcaaatattatatttggtgaaatttcttatataacaaaggcgttgtcggcagtattacaattagctgtaactatggattattcaattttcttactaaatagatatgatgaagaatgtaaaagtcagcctgataagactgaagctatggcagtagcaatagaaaaaactatatcatctattgctggtagttctttaacaacagttgccggattcttagcattatgcattatggaattaggttttggaaaagatattggatttgtaatggctaaaggggttgtatttggtgttatatgtactataacagtattgccagcaatgatattaacatttgataagcttattcacaaatataagcataagacgttattacctaagtttgaaaaaagttcagcctttgtgataaagcattacaagattattgtaattattggtgcaattagcttaataccagccattataggaaataacaatacagaggtttattataacttagatgaatcacttccaaaggatttaccttctagtgtagctaataataaattaaagtcagaatataacatgatgtctactaacataattttagtaagagatgatttagaagcatataaggttgatgcaatgattgatgaattaaaagctattgatggggttacttcagtagtaggtttagaagatttactaggacctagaattcctcaaagtttcataccaagtgatttattagagaaaataaaagatggtggatatgaagaaataatgcttaattctgagtataaggcagcatctgatgaggtaggggttcaattaaagaaaataaacaatgttgttaaaaaatatgataaaggtggattagttggtggagaggcgccattaacagaagatttgattacaatagcagatagcgattttaatagggttagtgtagcatcaattttagctatatttgtaataatactatttgtatttaaatcagcaataatacctatattattagttttagtaattgaattagctatttttataaatttgggtattccgttctatatgggaacaagcattccatttatatcatcaatagttataggaactattcaattaggagcaactgtagattatgcaatattattaacttctagatttaaagaagagttagcaataaattcagataagaaaaaagcaatgacaatagcacttcaaagttcatcaagatcaattttaactagtgctttaactttctttggggcaacagcaggggttggaattatatcagatatggaaatgataagttcattatgtacattaatggctaggggggcaattataagtatgtttgtaattctatttatattgccaggaatattattgctttgtgaaaaattaatagttaagacaagtaagtcttttgttgagtgtgttgaagggggaaaagaaatatgaaaaaagggttatcaaaaaaattagcgtgtttagttgcgttaataacagttacatcaaattcagtagttttcgctcaagatataaaaaaggatgaaactgtttatgttatattagatgaaaatggaaatccaacagagcaaattgttagtgattggattaaaggaagtgaaaatttagggcaatttacagataagtctacattaagtgacgttaagaatgtaaaaggtgatgaagaaccaactaaaaatggagatgaattaagttggaatattgattctaatgaactttattatcagggtaaaagtaataatcaattaccagtaacaatatcagttaattatgagtttaatggtaaaaaggttgagccaagtgaggttttgggggaaagtggtaagtttaagatttctgttaatataactaataatgaaagtaagacagtatttataaataatgaaaagagaaatatttatttaccattgttaactgcagcagaacttactttatctaatagtaactttagtaatgtggaagttagttctggtaaggttattaatgatgggaataattccttagtaacatttgtaacaataccaggattaaaagaatctttagatttgggagatgtattagatgacttattaggtagcagtagtattgatttatctgattcatttgaaattacaggtgaaactaataattttgagataccagcaataatagttttagctactacatcaagtgaaaatatagatgaaattgaaggtattgatagtttggatgatttaaggacatcattaaatgatttacaaaaaggtggggaagatttattaagtggatctaaggaattattagatggacaaacagaattagcaagtaattattctatatttaatgcaggagtaggaacattaaatagtggagctattgaacttagaaatggattaaatactttaaatggaagtgttccaacattactaagtggagtaaattcattaaatagtggagcaggtcaaattaaagagaattatgataaatttgatgaaggagtatcatcattagcaacaggtgcaagtactttaaatagtggagttaatactttaagtggtagtgtaccaacattattaagtggagttaatacattaaagagtgggtcaggtgaactaaaggataaatatacagaatttgatgctgggatatcatcattagcaacaggtgcaagtgctttaaatgagggcgttaatacattaaatgatagtgtaccaacattgaataatggagcagttgcattgaattcaggggtaagtgaattacaaggaaaatacacagaatttgattcgggagtagcaagtttagctgatggagctaaaaatttagatgaaggagtgtctaatttagaagagggatcaaaaagtttaaatgcaggtgctacagaattgagtagtggacttggaactttaaaatcttcacaagaagaatttacttctaaagttaatgagtatgtaggaggcgtaagtagtttaaatgaaaattatgattcaatagatagtggtatatcatctgcattaagtggtatgacagaattaaataatggattgcaaggagctggagatggaattggaaagcttcaagatattacaagtagcttaaagcaagttgcagagtcgattgatacaatggttacatcaattcaagacatagatcctactcaagcagaaatgctgagagaatatagcgctaaaattaaagcaattgcagatggtcaaagcgaaggattaacaaatttatcttctgcacttcaatcaggagcaagtggagcaaatgaactagaaaatggtttaagaaatttagctagtggatctgcagaagttaaagttggattatcacaattatcatcaaagggggattctttaaatgcagcagcacaagctataagtaatggaataagctcagcatatgatggtagtaattctttattagtaggaacatcaagcttgcaaagtggtgtaggtaatttaaagagtggaagcaatacattgttaaatggggctaattcattaaatgataattctaaacttataaattctgctatgggagacttatctaatgggagccaaaaattagctgaaggtacaggagttttattagagggtacaacaactttaagtgaaggaagtaatacattgttagatggagctaatgaattaagcaccaattcaaagttgataaattctggaataggatcaatatatgatggaacaaatcaattatcaagtggaggtaagacattagctgatggagtaagtgctttagcaacaggaagtaatcaattatcaagtggagctaatgaattaaatacaaattcaaagaagatagattcagcattaggtacattgtatgatggaacaaaggagttagctaatggaggaaagacattaaatgaaggggtaagtgctttagtaactggtggtaagacattagcagaaggtacaggaacattgaaaagtaattcagaaaagattttaaatggaacagaacaattaaaaagtggaacacaatcattatatgaaggtgttgataagctaaagaatgagggattagacaaaattaatgatttaggaagtgaagctttagatagtatcgatggatttagtcaagcaaaggatgaattagtgcaaatggcaaaggattatggtgtttattcaggattatcaagtgatatgaaaggatctgttaaatttataatgagaagtgatgctattgaaagttcagatattgataagacaacagatgattcaagcactaagaatacagagaataaatcagataaaagtgataagtcactaattgataaaataaagggtctatttaattagtaaattttattattaaggagcatgtaaattaatcatgctccttatattttaagaagttttttcttttttaaaccattttaaagcatttctaagcttaattggattaccatacattaaagtacctaatctataaatcttagcagatgcaagagctgttaaaatagttgaagcaagtaaaataataaatgaaattacaatttcaaaattagatacagttcccatcgcaactcttattagcatagtcattgaagaactaaaagggataaatgatgcaattttgataagtaagctatcactatttgataatccaaatatacttataaagaatacaataacaaaaatcattgttataggtccaatactagaacttatatcttctgttttagaaactaatgctcctaaagctccaaatataaatgaatagaagaagtatcctaaaccaccaaataaaataaaagttaataatatatttgatggaattttaaatatgccatctaaaaggccattccatgctttgctatttagagaataagttatcattccagaagcaagaattactccaacttgaataaaactagctaaagctgcagctattactttaccgaaaataaggctattactatttgcacttgtaactaagacttcaatggctctattacttttttcagatgttacagcaactgcaataagttgtccatataataaaatcatcatatacattgcaaaaataaagatgtacacataaaagaagttattagcactgtcttttccaaggatagtaacatcagaatcaaatgagggatgtataacagattgtaaatcatttatatttaagttatgttcatttgcataagcttgttggcttaagtttgataatagattttcaaaaatcatttggtttgtatctgtaaatcctgaattattaactaaatatgaatatttagttaagctatcaactgaaaaaccggcttctacattgtctgatttaattaatttttcagcttcatctaaactgttaaccttagtccatttagaatttaagaaagcagattctaaaatatctaaattttcaaaaatattattattatctattattacaaagttttttttattttcttcagagatttcttctacagactcaatactttctgtagagctttggtctaattgaggaataagtttagacatattaaaaaatgaaggtaaagataatcctattatcaataatatagaaaaaagaattgtagtaatcatatatcccttgtttttaaaatagttacttaattcaaagcttaatacattaaaaaattgtttcattattcatcaccagcctttaatacaaaaatatcagttaatgtaggttcatatattgcaaatttttcaatatcaatattagtagttaaaatatgttttaataagttattcttagtagtattttcacaaagttctaatactaaaaaatctttttttacttcgtaaatactaactaaattagcaagttgttcttcacatattttttttagttcttctagagaatagttacttgcacttaatataagtctatttttaccaaagtccttttttatttcttttaagttaccacttaatgcaacattacctttattaattatagcaatatcttcacaaaattcttctacataactcatttgatggctagagaaaataacaattttattgttttgaattaattcagtaactacatccttaagaatttgagcattaacaggatcaagaccactaaaaggttcgtctaaaactataatttcaggattacatactaaggtttgagctaattgaactttttgttgattacctttcgataaagtatctagtttcctatttgcatagtcttcaatacctagttgtttaagccattttaaagtgttttctttggcttcttttttacttatacctcttaatgaagcaaggtatacaatttgttcagtaactttcttttttggatataatcctctttcctcaggtaaatatccgatttgatgatttttaggtataaaaggtttaccatcaattaatatttcaccggaatcgcatttaaaaacatccatcaatattctaatagttgttgttttaccagcaccattcctacctaatagacctaatgccttaccactttctacagaaaaagaaattccgtgaagcacttcattgccggaaaaactttttcgtatatttttcacttctaatttcataaaatccccccaaaatatttaaatagaatttattaccgtaataaaagatttattttaaaatataaaacggtaatttataacttattataatgtacaaaatatataattacaatggttattaagaaaattttaacaaattttaaacaataagaaaacacaattagcaaaatttaggggataataataaaaaaggggctgtatcagattgaattaataaattcaatctgaatacaactcctttttggtgaacgtagttcagttggtagagcgccagtttgtggcactggttgtcgtgggttcgagtcccatcgttcaccccatttagggatatcgccaagcggtaaggcaccacactttgactgtggtattcgtaggttcgaatcctgctatccctgccatatttggtttactagctcagtcggtagagcacttgacttttaatcaaggtgtccggggttcgattccccggtaagccaccaaagcaactaagaattttcttagttgcttttttttgttgttaaatattacaaaaaatattgttaaatattacaaaaatattgtgagatgaaacaaaattattaaatactacagaaatcataaagagattagtataaaatttatatgaaaataataaggataggtgagtttatgatacgggttgagaatttaagcaaagaatttaaaagtaataaaaaatatccagggtttaaaggtgctattaaatcatttttttctacagagtatataactaaaagagctgtggatgacattagttttgaaataaatgatggggagatagttggatatattggagcaaatggagcaggaaaatcaacaactataaaaatgatgactggtattttaacacctacaaatggaagggtttttgttaatggcctagtaccttatgaaaatagagaggaaaatgcgaaaaatattggagttgtttttggacaaaagactcagctatggtgggatcttcctatatctgagactttttcattattaaaggatatatatgatgtaagtgatgaggattttgaagagagaatgaaattcttaaagggagttttaggattagaggaattctttttaagtccagttagaactttatctttaggtcagagaatgagggcagatttggcagctgcacttatacataatccaaaggtaatatatcttgatgaacctacaataggattagatgtagttgtaaaagaaaatgttcgtaaagcaataaaagaaatcaattttaaatatggtacaactattatattgactactcatgatttagatgatattgaggaactttgtaataggattattattattgataaaggtaagaaaatatatgatggagagattaaaggggttaaggaggagtatggatatttagcaacagtagaaatacaagtaaaagaggaaatttctttagaaaacttaaatatttttgatgatatatgtgaagataaagattttaaaatagattttaaagaaagtaaattatatattacatttaatataaataagatatcttcttcagagataataagtagagtaattaaaaatttaactgtagtagactttgctattaaagaaacaagtatagaggacattgtaaagaaaatgtataaaaatgaggtgtaatcgatgtttgaattgaagaaatataggacttatatcccctttactaggaatgtttttcaaagattaatatcctataaagctaatgtacttttctttatgtttggcgatttgcttatgttagctgtaacatactatttatggaaagctatttatgaaagtagtagtgaaagtatattaaatggatttggatttaatgaaatgataatttatatttttatatcatttattacttcagttatgataagtgttgatattagtcatgatatttcaagtgaagttaaggatggatctattgcaataaatttagttagaccgctgaattatgaaaaaagaatgttatttcaaggattagggaatgtactatataattttattataatttttataattacattttctataactacaattttatattataaattttttggctatttaagtgttgtaagaatattattatattttttaagtgttattatagggatatttattaacttttactttagttatatatttggacttattgcttttaaaataacaaatatgtgggggttgtcacaaataatgcaagccgtagtcaatttattgtcaggtatgttaattccaatagcatttttccctaaatgggcgcagggaataattaatttattaccatttagttcatcgatttatactccgacaatgatttatttaggaaagattaggggagtagatattttaattgcattaggattacagatattttgggtaatagtacttatgataatttctaagaaaatgtggaaggctttgattaaaaatttaactattttaggaggttaagatgtatgaggaagtattgcaaattatataaaaagtttttacaacaatatatcaagaccttgatagagtatagagcggattttattttaggacttataggttttttatttgtacaatctataggtgttatttttatagggttaatatttaataatataccatcattaaagggatggagtttttatgaaatattatttatatatggttttgctcaaattcctagaggaatagatcatgtatttacggatcagctttggatatttagttggcaaacaatagttgaaggtaaatttgataagtatttagtaaggccattaaatcccttatttcaagttatagtggagaaatttcaaccagatggatttggtgagataattataggaagtattcttttgatattttcatggattaaattaggtgttgaggttactgctataaagataatatcattagtcattgttattatatttgcgagttttatttatacagctataaaacttgctgttgcatctatagcattttgggttaaatttgcacaaagttatctttttatggtgtatcaattaagtggatttgttaaatatccaataactatttatccagcatggattaggaggatattaacatttataattccttttgcatttacaggatattttcctagtgcatatttactaggaaaagaaagtttcgtttcaggagttttgatgacttgtattataggtattgttagtttgttagtagcttatagaatatggttgataggtattagtagatatgaaagtagtggaagctaaaatataagaaatatacaaaaaggttatattaatatttatttaatataatctttttttgtatttaaaataccataacttttacttgtggttttagaaagtttttagattggcgtaaaaataatagaagcaaatacatgaaaaaattatatgcatataatttttagtatatcatgtaaattaagagtttcacagttcgagtgtatacgttaacaaatatttctacagtgttactgattaatgaatttgaaatcgatatgatatagataaattctctaaagaaccgattggaaaaaggtggttataaaaattttaaatggtaattatgataaacttcgattgttaatttaataacgaaagtagtatagtgagattgtagataaaaatttttataatcttaaaatatagtgtcggaggaatagatatgggatataaattgttatcaaatgaagtaaataatttatttgaagaattaaaaaaggagtatatgatatatgcaccaaaaagattcttaaaacaaggcagatattcagatacagatataattaagtatggtgaagttaattcttttcaagaaattgtttataaagaaaaatcgacatatccagcaaaagaattaattacaccaattaatcaaacgttatacttttttactgaagatgaatttagagaaagtaaaaatccatatggtgataaaaaaatattaatatttgcaagaccttgtgatataaatgcacaaaaaagacaagataaaatttacttagaaaatggtggatttgaagacgtcttttataaaagaattagagaaaaggttaagtttgtctgtatagagtgtgttgaaggatttgatacttgtttttgtacaacaatgggaagtaacaaaacagatgattatagcttagctgtgagatttgatgaaaattcagcattatttaacattaatgataacgagtttgataagtatttcacagattgtgctaaagaagaatttgaacttaaatttatagagaagaatatggcagaggttaatcttccagaaatagaaagtaaggaagtattaaataaattaaaagaacattcagtatggaaagagtatgataaaagatgtattcaatgtggaagctgtactgtagcttgtccaacatgttcttgctatacaactagagatataatttacaatgaaaatgctaatgttggagaaagaaaaagagtacaggcatcttgccatattgatgggtttgatgaaatggcaggaggacacaaatttagaactactgctggcgataaaatgagatataaggtattacataaaatacatgattataaagaacaatttggagataatcacatgtgtgtaggttgtggaagatgtacagatagatgtccagaacatatttctattacagcaactataaacaaagtagataaggcagttaaagaaattgttggaggtaaaaattaatgagcaatatattaacaccaaaagcatataaaattattgatataagaaaagaaagtaatttagaatatacatttaaagttgaaactgatattaaagttgaacatggacagtttttacaattatcaattcctaaagttggagaagctccgatatcagttagtgggtttggtgatggatatttagagtttactattcgttcagtaggaaaagtaacagagaaaattttcactttacaaccaggagatacattatttttaagaggttcttatggtaagggatggccagttgaaaaattaaaagataaaaatgtaattatagtagcaggaggaacaggggttgctccagtaagaagtatgataaatatgttttttaatgatgaaacatatacaaaaagtgttaatttaatatgtggttttaaagatgaaaactcagttctttttaaagatgaactagcattatggaaagaaaaatttgatactatatatacattagataaaggtgaaaaagaaggatttgaaagtggattagttacaacacatttatctaagttaccattcgaaaaatttggagataattatgaagtaataatagtagggccaccaatgatgatgaaatttacatctttagaatttgtaaagttaggagttccagaagataaaatatatgtttcttttgaaagaaaaatgtcttgtgcagtaggaaaatgtggacattgtagagtagatgaaacttatgtttgtctagaaggtcctgtatttaattatactaaagcaaagaatttattagattaggaggaattatattatgaatcacgatatagatataaagaagactagaataaattgtttccgtcaatcaaaagttcctggagaatttatgttacaaatgcgtattccagggggaacaataaatgcaaaatacttaagtgatgtagaacatatagcattaacttgggggaatggaactttccacatgggaatgagacaaacttttaatgttccaggaataaaatatgaaaatatagaatcagttaatgaatatattaaagaatatattaaagaagtagaagttgatgaatgtaattgtaatatgcctatagatgataagggatatcctacaataggtgctagaaatataatggcatgtatagggaatacacattgtataaaaggaaatataaatactaaggaattagcaacaaaggtagaaaacttaatattcccatcacattatcatattaaggtatcaattgcaggttgtcctaatgactgtggtaaggctcacttccaagattttggggtaattggtcaagctagaatggaataccataaggaaagatgtattggatgtggagcttgtgtaaaagcatgtgatcatcatgcaacaagagtattaagtttaaatgaaaatggattagtagataaagacccatgttgttgcgtaggatgtggtgaatgtgtattagcatgtccaacaagtgcatggacacgtagtcctaaaaagttctatagaatagttataggtggtagaactggtaaacaaaatcctagaatgggtaaaacatttgttaactttgcaagtgaagaaacggttcttggaatatttgcaaattggcaaaagttctcagcttgggcgttagattataaaccggaatatttacatggtggacatttaatagatagagctggatataataagtttaaagaaattattttagatggtgttgagcttaataaagaagcgttagttgcagaaaatatatattgggcagaaacagagtatagatctaatataaacgttaaagctataagcaagcataaatcaataagtacaactagacctattaaagataattaaatataaaaatagataaaaatagtagcatgataaaatatttaatttacaactattaaatattataaagtgctactatttattttactaaaaatttataatataatgattttaatattataaatgagaggtattaagtatgaaggtaacaataaaggatgtggcaagagaagcacaagtggcaacgtctacagtttctagggtcttggcaaatagcgcaaaaataagcgaagaaactaaggaaaaggtaaatgaagctataaaaaaattaaattatacgcctagtatagtggcaagaggattagctaataatagaactaaaatattagctgttctattgacgggtggagcagaggtttcatttgaaaacccattttttgtacaagcaatgaagggaattagtatgtatgcagaaaaagaggattattatattatgtatgcatttaaagataaaaaagctgatgaagaggaatgggtaaggaaagtaacagaaggcaaccttgtagatgggttatgtctttttaatgtaaaagagaatgatattactattaattatttaaaggaaaaacaatttccttttgttgtaataggtagaccggaacaaatagaaggtgttttgtgggttgataatgataattttgcagctgtatataatttaactcaaaagttaattgaaagaggaaataaaacaattgcatttattggtgctaaaccggatataaatgtttcaaaagatagattaaatggatacaaacaagccatgtatagcagaaatatggaaattaataatgatttaatacttgaaatgaaaagttttactgaagaagaagggtatattgcaacgcataggattctagagaaaaataaagttaatgctattattgccgcagatgatttattaggttttggggtacaacgagcaatagaagaattaggttataatgatatatctgttgttggatttaataatattcctttagctcaatataaaaatccacccttagcttcagtagatataaattctgaaaaattggggagatatgcaataaagttaattatagataagttggagaacagagaaaataaaggttatcatgttatagaaacaaatttaatagagagagaatctttgaagtaaatatataaattgtgcaaccgattgcattaatggaagaaaaaaagagataattgaatgtaatcgtaaaatttgaaaaaatttggctgtaattagtgttgtaaacaatttctgaaaatgttatattaaattcaggaaatataaaacaaacaaataaagataagctaaaaggcttttctataaagcatgtacagttatgaaactgtacatattatttaaatgattgtgcaaccgattgcataaattaggggtggaaatatggaaagagtttggtggaaagaagcagttgggtatcaaatatatccaagaagttttaaagattctaatggtgatggaattggggatttaaagggaataacatcgaagttagattatttaaagaatttggggattgatgttatttggatatgtcctatgtataagtctccaaatgatgataatggatatgatattagtgattatcaagatattatggacgattttggtgatatgaacgattttgatgaattgcttaaagaagcacatgatagagagatgaaagtgataattgatttagttgtaaaccatacaagtgatgaacataaatggtttatagaatcaaagtcatcaaaagataatccaaaaagagattggtatatttggagagctggaaaagataataaagagcctaataattgggaaagtatttttaaaggatctgcatgggagtttgataaaaatacagaagagtatttcttgcatttgtttactaagaaacaacctgatttaaattgggataataaagaagtaagagaagctatttattcaatgataaattggtggttagataaagggattgatggattcagagtagatgcaataagtcatattaaaaaagaagacggtttaggggatatgccaaatcctaaaggattaaaatatgtagaatcatttgataaacacatgaatgtttctggaattcataaatatttaaaagagcttaaggaaagaactttcgataattatgacattatgactgtaggagaagctaatggagtagaagcagaagaagcagatttgtgggtgggagaaagagagggaaaattcaatatgatattccaattcgagcacttacatttatggggagctgaaagtgaaaataattttagtgttagaaattacaagaaagtattaacgaaatggcaaaaagctttatatggaaaagggtggaatgcattatacatagaaaatcatgatattccaagagttacatcgacttgggggaatgatcaagagtatttaaaagaatgtgcaactgcttttgcgcttatgtattttatgcaacaaggaacgccttttatttaccaaggacaagaaataggaatgacaaatgtaaaatttgattctatttatgattataacgatgttaagggaataaatatctataaggaaaaggtagaacaaggattaagtaatgaagaagcattaaaatatgtatgggcagtatcaagagataattctcgtacgccaatgcagtgggatagtagtgaaaattcaggctttactagtggaaagccatggatcaatataaataagaattataaatatataaatgtagaagatcaattaaaagatgaaaattcaattttaaatttctataaaaaaatgattaacataagaaaagaaaataaaactcttatatatggaagctatgagttaatattagaagatcatgaaaaaatatatgcttatacgagaataatgggagaagagaggtttgtaataatagttaatttatctcatgataatgttacgtattcttataatattgaccttagtagtgatggattattattaagcaattatattgttgaaaaacatggtttagaaactgaatttgatttaagaccatatgaagcaagaatttataaggttataaaataaaaaaatatatttaataattaaaatatttgcagtaaagtgaattgcaaatggaaaaaaggggaattaaaatgggtaaaacaaagaaaaagggtaaattattatcatttgatttttggcaaaagtttggaaaggctttattagtagttatagctgttatgccggcagcaggattaatgattacttttggtaagcttctaggaatgtattttgaagctgatataatacaagctatatctaggattatggataatataggatgggggattattggaaatctccatatattatttgcagttgcaataggtggatcatgggctaaagaaagagcggggggagcttttgcagggttattatcatttgtgttaattaatcgtattacaggggcaatttttggtgtaagtacagaaatgttatctgatagtacagcaacagttaagtctttactaggtgcaacattaacagttccagattactttacaagtattttaggatcaccagcacttaatatgggtgtatttataggtattatttcaggtttcttaggggcaacgttatttaataaatactataattacaataaattgccacaagccttaagcttttttaatggtaagagatttgttccttttgttgttattttatggtcaacagttgcagcattagttttatcagtagtttggccttttgcacaaggcgcattaaataactttggtatttggcttgcaaattcaaaagatacagcaccagttttagcgccatttatatatggaacactagaacgtttattacttccatttgggttgcatcatatgcttactattccagttaactatactgaattaggtggggtatatacttcattaactggagcagctgctggaacagtaattgctgggcaagaccctttatggtttgcgtggataacagatttaattaactttaaatcagcaggaaatatgacagagtacaataatttgttagctacagtagtgccagcaagatttaaagcaggtcaagtaattttatcaacagcatcattattaggggttgcgtttgcaatgtatagaaatgttgatgcagataaaaagaaaaaatataagtctatgtttatatctataggattagcagtatttttaacaggtgtaagtgaaccaatagaattcttatttatgtttatatcaccaatactttatgtagtttatgcaatacttgcaggtttagcatttgcattagcagatataataaatttaagagttcatgcatttggagcaattgaacttataacgcgtataccaatgcttgttaatgcaggattagttggagatgttataaactttataattgcatgtttagcattctttggacttaattttggagtatttaatttctgtattaaaaagtttaaaatacctactccaggacgtttaggaaactatgatgaagaaaaaggtagtgaagaagttaaagaagtagctgtagataaaataatatctaatgatacattagctataaaaataatttctttattaggagaaaaggaaaatattgaggatgtagatgcttgtatgacaagattaagagttactgtaaaagatattgcaaaagtagcagaagaaaaagagtggaagaaaaatggtgctttaggattaatattaaaagatagtggagtgcaagcaatatatggtccaaaggcagatgtgttaaagtctgatattcaagatataataggagtataatatgaaacttttaactttaaattgtcattcatggcaagaagatgatcaaattgaaaaaattagatatttagctaaagtaataaaagaaaaacaatatgatgttatagctcttcaagaggttagtcaaagtataaattcgaaattattacatgctatgataaaagaggataattttgtacagttattaattcaagagttaaataaaattgatgaaaataaatataactttatatgggattactctcatataggttatgatatatatgaagaaggagtagcaatattaactaaacatgaaataaaagatactaaagccttttatatttctaaaagtgataataaaaaaaattatcgaagtagaaaaattttaagtattacagttaatgttgaaggtaatgatgttgatttttatagttgtcatacaggatggtggaatgatgatatagaacctttcaaatatcatgctgatatgcttattgaaaatataaataatgatagaatggcctttgttatgggtgattttaacaataatgcatatgtaagaaatgagggttatgattatttaatagaattaggattaaaagatacttatgtaatggctaatgagaaagataatggtgttacagtaagaggtaaaattgcagggtgggaaatgcaagaagaagacaaaagattagatttaatacttacaaatagagagataaaggttttagagtctaaagttatatttaatggagtgaataaagatattatttcagatcactatggggtagaagttttagtataaatgtgagtatgatattcttttatagttgtaaataaaagttattatcaatataaagaaaaaggaagatagtgtaaatattatacaatatttacactatctaattttattaacttatttttttgtggagttagttatttcattccttgttcgtattgttcaaccattctcttaaccatttctccaccaacacttccgcattgtttagaagttaagcttccgttgtagtctgtgaaaggaacacccatttcgcttgctacttcattcttaaattttgataatccgttttttgcttctggtactaacttttgagccataaaagaccctcctttaaataaattaatatttattttcctttgtaagtaatcacttttacttacactagtattatgtgtagaagtaatttatataatctataaaagtaaaggaattagagggataaaataatatattaaccgatatatggaaaatggattttacaaagaaaattaaatgcacacttcgataaatattttatcaaaatgtgcatttaaaaatagttagtttctttttaatttaagcattgtaacgactattggaattgttattagtgctgaagcgatagcttcaggaattccatttgtcaatccagtggtaagtaaagtaccagcaacagcttctcttgaaatctctctagcttgtgcatatttatcaagatatagaatataagttaatcctaacacaccaattgtattagttaatgtacctaaaaccgcagctatcccaacacaaactcctgtatttttgattttgtttttaaatagtttaaatgaataataagctacaataccaattaacattcttggaattaaggctacaatgggattccagaatataaaagaagttaagccgggagcagtaatattttgatacattgaaaataatccaaaaatcaaacctactgatattccaacaactgggccttctaataatgcccctataattactggaatatgcataatagtaagactgaatattggtaaacgtattaatcctaatccgcttacaccaaggaatattgaaattccacctagagctcctatgagaacaagtcttctagtcttagagctagaattttttttatttttcatctatctctctcctaatttattattgaaattttataactatatccaaacattaatttaatataaagtaataaattattcaagtattattagtaatataaataaataaaatgctgaataatgaaataaaatgttgaatagcataggaaatgtagtatattatgaaagtgtaaagtaattatacaaggagatgaagaaaatgagattatttagtattaaagatttaaattttaatgaagaggactttttagataatataaatgaatatgaagatataattcctataattgaagaactacaaaattctttaaattatgatgaaattgaatgtgttggtgaaaatgaatgttgtaataaaactaataaaaattatatagtagaaattcagggattcataaatgaaaatgatgaatttataactaaggaagagcttgagagtaatgctataatggtacaagagggaataatggacttattcgtaataagattatataagtgcgttgattgtggaaaatggattatagatattttggagtagtattaaatgactaaaataaatattatatttaaggatatagtcaagaaatgtaaagtttatatagaaaataaaataagtgatgtaaaaaatataaaagaattaggaataatagaagtggtaaatagaactaagctcattagtatttcattaatttcttttataataattttgggatttatattattcaatgcaataaatataagtaaagaggaaatgttaaataatttaaaaaaatcattactaacagaaaatagctctaagattgctaaaattataagagtaaaagatgaaaaagtagctaaaaatgattttaatcctctcattaggtattatagtggaaatgaagataaaattaaaaaattgataaatgaattgcgaaaaagtggcgagtatgcaaattttaaaataaaaagtaaacaaggattattttataaaaagtattatattgatttagatactgttgaaattgaatttgctacagatattaataatgtaaaagttgaatttgaggataaaaagtttaacttgcaggattttgctgagtttgatgttattcctggtatttatgaggttaaatacacttatgaaacagaatatggtgatatttctaatgaaattaatataagcatatttgaagataaaaagttcgaacttaatattgatgggaattatgttactttatattctaattttgaggatgcaaaagtattaataaataatcaagatacaggtttgttatcaaatgatattaaaaactttgggcctatacctaaggggaaagatatagtaattaaattacagagagaatttccttggggaattatagagagtgatgaagaaaatataagtaatcaggaatatattaagctagatataaacatggtaaatgatgagttgatgaatatcataagtaaagatattaataagttttatgaatctgcatttgaaagtttaaataaaagaaataaggaaaatatacttaattgtaccgatggggttaaagatttagtatataattatataaacgaaaaaacattactattttctaataactatgaaattacagatatgaatgtagaaattgaaaaaagtgattttaaatatgaagatagtacttataaggcaagtgttgtaacaaaggtgaattataatatttacaagaaattattaccatttttaaaaacacctaatgaaagttcatttatattagcattagaatatattaatgataattttagaataactggaatacagaagattgaaatagagtgaagttttaaatcgaatgattataatatgggggagatatgaagtttaaaaacaaaattatttatgcagtattaattatattgttagttaatacaaattatgtttttgctgaaaaaagtgattcaattaaaaatgagatagaagataataaaagtaaaattgaaagtttaaaagatgaaaaatacaatttaaataatgaaattcaagataaaaaagatgaaattaacgacttagaggataatattactgaaaaggaaaatgaattatatgcacttcaacttgaaataagtgaatatcaaaaacaaatagataatatgcaaagtgaaatttctgagctgattaattctataaatgaaagcaaattagaggttgaaaataaagaaaactatattatagaactgaaagaggaagagagtagaattaaagaattattagacgcgcgagttagaagtgtttataaagttgatttatcaaaacaatatatttacatgttaattagaagtaagaatatatttgaaatttttcaaaatttagacaacataaatcaaataataaattttgataaaaaactaattaagagctataaggaaaatcaacaaattatttcagatgaaattgcacaaatagaacttaaaattacagagcaagaagaagctcaagcagtaatagaagacaagcaaagtggtataatagaagtcaaaaataaagttgttgcaattcaaaaggaagaggaaagtaagaaaaatgaacttttagcaattcaacgagaaaagcaaaataatattgttgctttagaaaatgatagtgaaaagattaatagtgaaatagcagagttagagtcacataatgaagaattagaagcagaacttgataggataataaataatgttagcggtagtaatgggagtaatgacgtagataataacctacaaacggaaagtggttttttaagacctatctctggtagaattactagttattatggttataggataaatccagttactggagaatataaattgcataaaggtatagattatgctgggaattatggagatcctattaaagcatctaaaagtggagtagttgaatattcaggatggattactggctatggaaatacaattattttaggacatgggaatggggtacaaacattatatccccatgcacaaactttagaggttgattatggtgatacagttaagcaaggtgatgttattgctactgtaggttcaactggaaatagtacaggcccccatttgcatttcgaaataagaatcaatggagaagcagttgatccattaaattacataccatattaaaaagctgtatctttaatgatacagctttttgaataattaaatataataaagaaaataatacttaggtagtttttagtttataaaaattaaaataaaaaaacctgtgcaaaatgcacaggttaagggattacaatcacttaagaaagggaataagtgattgtgtggggttttattaaaactctataatttgttaaattatagagcggtatgggctttatttaataaatattctatcaaatactatagttatattatacaatataatttaataaaatcaaataatatttacaaaaaaagttgaatttttttttaatgtgtataaatctagaagaaaatagatgataaaattaaataaaatagcagttataaggaggaataaaaatgaaaaaaagagaaaatgtgcttaagaatactccggattatgaaccttattcagaaaatgaagttagattgagtattaaggagatgagggagatggggcttattaaatgcggtggttgctgtaataatgggcaaggaggatgcggtaatgtgaaaagctgtaataaaaaatgttataataaaaatagaaaagtaaactagaatgtcgaattctaaggaagaaaagtttggaaaaaaatgattataatagaattttaaaagttgaatactattaatgcaaaaaaataatattaattctttgaatatatatttaaagaaagggatagtatttattaatgaaattgcgtaggaataaatacagtgtagttttacagaaaagtataaatatataaaagtataaatatatattagtgagaataatttatttaagaatgtcttgaaagaacatattataattggtaaaatatatcgtaattaattgattttttggttaagaataatagattgcttagataggaaaagaagcgctgattatgaatatatacagagaaaaattttagtatattgtatgtaatgagtaaaatattagatgttttttgctttttatgaacaaacatttgaaaaaattagctttaatatgttataatgagctagttgtattaatcaaacaagagatacttttttaggaggaatatacaatggaagctaaaatggaaagaatcgacgtaaatgtcgttaaatttgaagtaaaggttgaggctaataaattcaatgaagctttaacaagagcttataagaaaaatgttaagaattttaatgtgccaggatttagaaaaggtaaagttccaatgaacgtagttaagcaatattatggagttggagttcttttagaagatgcagttaattttgcaatcgatggatcttatagtgaagtattaaaagaaaataacataataccagttgattatccaaaagtagatgtagtagaagttggagaagggaaagacttcatatatactgcagaagtaactgtttatccagaagttgaattaggtgaatataaaggattatcagtagaaaagaaaacttacgaagtaactgaagaagaagttgctaagaagcttaaagaaatgcaagaaaagaatgcaagagttgaatctaaagaagaaggaacagttgaaaatggaaatatagctgttattgatttcaaaggatttgttgatggtgaagcattccaaggtggagaaggtcatgattactctttagaaattggttctaaaactttcatagatacattcgaagaacaattagttggagctaaagtaaatgatacagttgaggtaaatgttactttcccagaaaactatggtaaggaagaattaaatggtaagccagctaaattcgaagttactattaaagaaataaaagtaaaagaattaccagaattagatgacgaatttgctaaagaaacttctgaatttgatacaatagctgatttaaaggctgatattactactaaattagaagcaacaaacactgaaagagctgatagagagttcgaagaagcggtaattaatgctgttgcagaaaatgcaaaagttgaaattccagctgttatgatagaaaaagaagtagataaaatggttcaaaacttagaacaaagattacaatatcaaggtttaaatttagaacaatacttccaattcactggaactgatgaagaaaaaatgagagaatatatgagagaaaatgcagctactaaagtaaaagttgatttagttttagaagctgtagaaaaggctgaaaatatagaagctactgaagaagaaataaaagaaaaagctatagaagttgctaaaatgtattctgcatcagaagatgataaaatggtggaattattaatgcaaagccaacaagcagcattaagatctgatgtaatcacaaataaagcaataaagttcttattagaaaataataaatagtcctaatttaattgccagaagaaattctggcaattattcaaatatttctttaacaaaataaagtaaattttatataattttaatataattacttttgattagttggatatattaaaagtaagaagggttttaaagagaaaaggagggaatgaagtatgagcaattatattccatacgttgttgaacaaacaggaagaggagaaaggtcttatgatattttttcaagacttttaaaggatagaatcataatgcttagcggtgaggtaaatgatgtaactgctaatcttatagtagctcaattattattcttagaaagtgaggacccagataaagatatatatctttacataaatagtccaggagggtcaattacttcaggaatggctatttatgatactatgcaatatattaaatgtgacgtaagcactatttgtattggtatggcagcgtcaatgggagcattcttattatctagtggtactcaaggtaagagatacgctcttcctaatagtgaaattatgatacatcagcctttagggggattccaaggccaagcaactgatattgatattcatgcaaagagaatattaaagataaaagaaacattaacaagaactatggctgaatctactaatgggaaagttgattatgaaactatggttcaaatgtgtgaaagagataacttcatgagtgctgatgaagcgttaaaaattggattaattgatgaagtaatagtaaaaaataaaaaataattatttttggcaatttcatgccaaagtgaggtgaggttatggctaaatttgaagataaaaagcaattaaagtgttcattttgtggtaaaaatcaagatcaagtaaaaagattaattgctgggccaggagtatatatttgtgatgaatgtatagatttatgctcagatataattcaagatgaatttgaagataatgtagagttagatactacagctcttcctaaaccaaatgaaataaaagaatatttagatcaatatgttattgggcaagatagagcaaaaaaagcactatctgtagcagtttataaccattataaaagagtgaaagcaaatacgtatgatgatgatatagaacttcaaaaaagtaatatattattattaggacctactggttctggtaaaacacttttagctcaaacattagctaagttcttaaatgttccatttgcaatagcagatgctactacattaactgaggcagggtatgtaggagaagatgtagagaacattttattaaagctaatacaaaatgctgattatgatgttgaaaaagctgaaaagggtatagtatatattgatgaaattgataagattgctagaaaatctgaaaacccatccataactagagatgtatctggtgaaggggttcaacaagcattattaaaaatattagaggggacaacagcttctgtaccacctcaaggtggaagaaagcatccgcatcaagaatttatccaaattaacacatcaaatattttatttatttgtggtggagcttttgatggaattgataagattattcaaaagagaacaagagttagcactatgggatttggagctgaaattcaatcaaaagaagcaaaagatgttggagaattattaaaaaatgttcttccggaggatttattgaagtttggtttaattcctgaatttgtaggaagattaccaatggtagtttctctagaatcattagatcaaaatgcattaattaatattttaagtcaacctaaaaatgcattagtaaaacaatataataaattatttgagttggataatgtagagttagagttcactgaagatgcacttaaagctattgcagatgaagctatagcgagaaaaacaggtgctagaggattaagagctattgttgaagatataatgattgatgtaatgtttgatgtgccatcagacgaaaatataagtaaggttattataactgaagattcaataaaatctaaaaaattaccagaattaattagattaggtgaaaacgaagttaggcctattttaaaatctaaaaaaactaaaaaaagaaaaggtatggaaacagcctaaaaaaatcacctctagatttctagaggtgatttttattttgagatttatcctaaatatagaaaaaataatacttattactatatactatggaataatagaactattataggttaataatagaaatagagtttatgaaaagggaggatatgagttcatgagtgaaataatgattgttttacaaactataatgatggttctatttattatttatttatttaatagtaataaagctaatcgttctagaaatgttgtggttgataaggaaaataaaaaggaaatggaaaaacttttgaagatgaaaaggataaagctttcagaacctttgactgaaaaaagtagacccacttcatttgatgatattattggtcaggaggatggtattaaggcactgaaggcagctatatgtggacctaatcctcaacatgttataatttatggaccacctgggataggcaagactgcagctgcaagattagtattggaagaggctaagaaaaagaaagcttcaccatttaaagaaaatgctaaatttgtggagattgatgctactacaattagatttgatgaacgtggaatcgcagatccactaataggatcggtgcatgaccctatttatcaaggggcaggcgctttaggagtagcaggtataccacagcctaaacctggtgcagttacaaaagctcatggaggaatattatttattgatgaaattggtgaattgcagcctatcgaaatgaacaaattgcttaaagttttagaggatagaaaggtatttttggatagttcttattatagctctgaagatccaaatatgccaacttatattaaagaaatatttgataatggattgccagctgattttagattaattggagcaacaacacgtagtcctgatgaaataattccagctattagatcgagatgtgttgaggtgttttttagaggtttgcaaccagaggaaataagggaaatagctaaaaaagcaattatgaaagtaggattgagtacttcagagaaggggttagatcttataagcagattttgtaataatggaagagaagtagttaatttaattcaattatgttctggaattgctattaatgaagaaagagataatattactgaggatgatattaaatgggtaatagaaaatggtcaatatacagaaatacaagaaaagaaaattttagataggccagaagttggggtggtgaatggattagctgtacatggagctaatattggaatgcttatggaaatagaagcaacagcaaaaaaggtagaaggtagagaaggggaattaaagatttctggtattattgaagaagaagaaattactatgagtaataggaaagttaagagaaaaagcacagcattttcttccatacaaaatgtattaactgctttgaataatatatataatttaaactgtgataaatatgatatacatattaatattcctggtggtataccggtagatggaccgtcagcaggtatagccattgcaacggcggtatatagtgctatattagaattaccggtagataacagagttgcaatgacaggtgaaattggtcttttgggtatggttaatcctataggtggtgttaatgcaaaaatactagcagctcaaaaagcaggtgcaaatagagttataataccatctggtaattggaatgaatcatttttagactatgaaggaattgatataattaaagtttctaatataaaagaagtattagaattgtgtatattaaataatgataaaacaaaaattgatattctttcagcaaaagcaaaagagttataaaaatgttaaatgacaaatgctgattataggtatttgtcatttatttttttatagaagcttcaatatagataaattaatataggaattagtataaagttgaaaaaaaatagttttacgtgtataatttaaaagttagatagtttatttatgacgatttgaatggagggggaaaatgaatactgattctattttattaccattaatacctctaaggggtattactatttttcccaatatgattatacattttgatattggaagagaaaggtctattgcagcgcttgaagaagcgatggtaaacgaaggaaaaattttcttagttacacaaaaggatcctgaggtagaagttccaaaaagtaaagaagatatgtatagtataggaactatatgtaaagttaaacaaatacttaaattaccaaaaggaacgacaagggttttagttgaaggaattgaaagagctacactattagaatttgaggaaaaagaaaaattcttacaagctaaaattgaaagaatactggaagaagtaactgaggttgaaagtaatgaagatatagctttcagaaatcagttaggtaaagcttttgcagagtatatttactcaacagaaggtgatgatagtaaagtacttaaaatgatggaacaagagaaaaatttaagtaagattactgatttaatagctgcatatattcaattagatgataaaaagaggcaatcaatattagaaactatagatgtctatgaaagaatagaaaagttacttgtatttattgatgaagaaattcaaatagttgaaatagagaaagaaataggaagtaaagttaagactaagcttgataagagtaataaggaatatttcttaagagaacaaattaaagctattcaagaagaacttggagaagatgaagaatcaagagaagcaaataaatatgtacaacagctaaggaaatttaggctttctaaagaagtaaaagaaaaggctgaatatgaattatcaagattaagaacatcaaattcaagtgaagctaacaatataagaaattatctagattggctagtggcaattccttggaataaggctacaaaggattcctttaatatcaaaaaagctcaagaaattttagataatgagcattatggattaagtgaagttaaagaaagaattttagaatatttagctgtaaaacaatatacaaaatctttaaagggtcctatactttgtttagttggaccacctggagttggaaaaagttcaatagctgaatctgttgctaaatcattaagtagaaagtttgttaggatttcattaggtggtattcgtgacgaagctgaaattcgtggtcatagaagaacttatattggagctatgccaggaagaattatttttgctttaaaggaatctaaggttaataatccattaatattattagatgaaatagataagttaagtaatgattataaaggaaatcctgctgatgctttattggaagtattagatcctaaacaaaataaaacatttagggatagttatatggaagttgaaactgatttatctaatgtaatgtttataacaacagcaaattcattagatactattccgccagcgcttttagatagaatggaaataatacaggtttctggatacacttatgatgaaaagtttaatattgcaaaaaaatacttgctaaaaagggtaatggatgaatgtaaagttgaaaataatgcaataaagatatctgataacgccataaaagaaattattaatggatatactagagaatctggagttagagatttagaaagacaaattaataaggtagttagaaagagtattactgaattaataaagacaaataaaaagaatattattgtttcttcaagtaagctagaaaagtatttaggaccagtaatttttaagtatgagaaagaagaaagagaagataaagttggagttgttactggattagcatggactgcatatggtggagatactttaccggttgaagttgctgttatgaagggaagcggtagattagagttaacagggcaattaggttctgttatgcaagaatctgcaaaggcagcatatagctatgttagagctaattttgataagtatgatattccagcagaattttatagaaaaaatgatattcatattcatgttccagaaggggccgtaccgaaagatggtccgtctgcaggcgtgacgatggttactgctttagtatctgcactatctaataaaaaagtaaaaagtggtgtagctatgactggagaagtgacattaacagggagagtattacctatcggtggagttaaagaaaagtgtttagcagcacatagaataggaatagatactgttattttaccaaaagataataaaaagcatgtaaaagaaataccatcgtcaattaaagggaaattaaatttaatttttgctgataaagttgaggatgtattacaaaatgcattaatcggagttgataataatgataattaaaaattcagaatttattatatctgctgttaaaaggaatcaatatcctatagatggcagaaatgaaattgcctttgttggaagatctaatgtaggtaaaagttcaataataaatgccttaacaaatagaaggaaacttgctaaagtttcacaaacacctggaaagacaagattaattaattttttcttaataaatagtgatttttatttagtagatttacctggttatggatacgctaaagtatctaaaaaggaaaaagaaagttggggtaaaactattgaaatgtatttaactgatagagaagaattaaaaagagtaattttacttgttgattcaagacataaaccaacagcggatgatattatgatgtatgagtggataaaacactttgattatgattgtatcgtaattgcaacaaaaagtgataaattatctaataatgagttaggtaagagtaaaaagataataaaagaaacgcttggtcttggaagtactgataagttttatttcttttcttcattaaataaaaaaggaaaagatgagctgataaacaatatttttgaagatttatcagaagaggctaagttaatttaataaaaaagctacctgtataagggtagcttttttatttaagaaaagataaaaaatttttgatgtggaaaggaaaatagtgtcaaataaaaataaagagaatagtatatagtataaaaacaaaaaaaaataaatccttaggaggaatgtaaagatgcctagtatgcatgatatgattgatgaattgaatgacatggattgtcctagtttttcttcagcagaacctattggaaacaatttttgtaatactggttgtggttgtgggtttggtagctggatttggatattattaattttattctatgctggacaaggtggaagtgctaatacaggatgctgctgtggaaatacagcttcaaataattgctgttgtaataattcttataataataataatggatcattttgcggcggaggatatttattcttacttgtaatattattcttatgtaatggtacttttggttgtggaaataatggatttaattcaaactgcagtggagctctactatagcttagtaggaaggaggaataattatgtcaaagaagagaaataagaaatgttgttgccaagagtgttgtgaaccttgttgctgcaataatgcagtagctaacaattatggatcatgctgtggaaatgtttttggtggattaaataattgtgtagcaccaattatatttttattaattgcttgtggatcaggacttcttaataataactgctcatatttaataatcttattattcttactatgtggtggatcttatggaaatctatttggaggaaataccgtaggaagcaattgctgctgtgaaagtgactgctgctgctagttaagaggatggagggcctttatgaccctccaaaaaaatatccttttttataaacatatataagttaattacatataatggagtaaagaaataatttggaggtacttatatgtccaagcgtaagcataaaaatagaagcgatactagacgtgaaggtacaagtgataatagaaataatgctaacgtaaatacaaatactaatagtagaccaacatataatagtggaccatttggtataaaccctaatcaattattgagtagtatgttcggaaatattgatatgaatcaaataaatagtttattacaatcaatgaatacacaaggatttgattttaataatttgaacttaggaaatttaatgggaaatatgaacaatatgggaagtgtatcaaatataaaaaacaatacaagcgctaacaatcagtcttcttcgaataatgagagtagtaatactattaaagatgatttagattttggcaccaatgaaaaagttgttgctagaggcgaaaggaatgatgataatattcaaatgcttagagctattagaagtattgtaggtggagagagaggagaatttatcgatagggtaattactatgtacaatgatggtatatttgatgagtaataaaattttaaaggtgtataaaatttagtaaaaggttaatactattaatgtaccggagagtattctcctatagcaaatgaagagagatcttcattaaagctaaacccccccatcccccttttaggccgcttttttagcggccttttatattacttttttaataatgaagaaattttaaattgatttgcttcgtctatttctgcagtaacatataagagaagctcttttggctttgaattagagttagtaaaatttattttctcgaaagatagtatccagcataatgaagatgtattaccagattcattccaagtagtatcataacaataagctttttgaaaagaatacctataattatctttatctaaattccataataatcctaattgatcactttctattgtagatgtaaatatatcaggaacatcatcaagttcataatcagcttcgatacaatctattaataattgaatagaactaagagatggtatttttggtgcactaaaagtaatatcctttagtgtgctagaatttaaaatatatccttctgtagattcgtcacccttagaagaagaggttgtataaagtttaggcgttttagaattattaaaatctaaaattgataatatattgttttgggtaaaaaatacttcttgaaagctgttattttcccatttaaaaatataaaaggttgatttattgttttttaatccgcttattataatttcaggaatcttatttctgtttaaatctatgtataagatttttatagcacaagatggagaaatatcaagtaaagaataatcaaattcgttgctttttaatagtgtttctccgaatgaatttttaatttttattgaataagttgaatttgttgatataatggataattcatcattttcgccatctccatcaaaatcatattcttcgttatttttattgttattatacgaattagagagtgtttgtacatttttcatgtatgtatttaagtataaccctaaaatgattacaaaaaaaattaatagtattaattttaaagaattatttttttgtaaattgaaattaagcatagtatcacctcagtaaagtatatgtgattactatgtaataaataacttttataaaagaaaaaaagccagcagaatactactgacagtctttacataatccatagaagaaaagtttattccattttaccttgtaatgagtgttttcttcaaccattttatttaatggtgaaaaatctacgtcgcataaatcatcaactttaccacagtgaatacattgtatgtgaccatgttcactacaatttccatcatatctaaagtttccttcaccaacatttaattcttgaaccaaacctatttcaactaaagtttttagagttttataaacggtagcaagactcatagttggatagttaggttgtaatgctttataaattgtttcggctgaagggtgttcgcttgtgctttttaaatattgataaacagctaacctttgaggtgttaattttaatttcttttccttaaatgttaaaattatatcatccattaatgacaccttcctatatttatttaatataattatataagcaaatataattatttgtcaataatatttattaaataataaagcattctaaagaaaatattattgtaaatatatgcatattgtgatattttataagaagaataagaattaatttgcacatataaaagatgcaaattgcataatataaagtttagtattatgtttaaattaaggaggagaatttttatggcaaaatataaggttggtgacgaattattaataattaatgatcctagcgaagaaaataaaaaattagaatctttaactaaattaactcttgacggtgattatgcacaaatatcatgggggttaaaaatagttaatgttgaatatgaaaagccatatgttacattaacttatactaatgttgatggtgagttaaataaggtttttgcagaatgtagagatattgaaaactttgatcaacaaaaagttttagagaaggctttattaaaagcgttccaaaatgaaataattaaaatttctgtagtaaaaaatgcagcattaaagaaatagtaaaaagaaatagtaaaaagaactagtttcaataagaaattagttctttttttattgaaataatataaaaatattgatttaatgagaaattatgttatattatatataaatagtataaaatggtgagatatcagatgaatatttatagaatgtaaagtttttgtaatttattatgaaaatatgtagaagtatttatttattaatggaaatcatatataataagtgtgtgatttcgtttacaggtaagtgggggtatgggttatgagtaaatgtccattttggtcaagcagaaaggaaaaagttagttgtagtaatgagtgtccaatgagtccaactctaaataacaatgaaatttgcccttttattgaacatttagcaggggagaagattatttttaaagatatacttgatgaggattttgcatattctcaagatactaaactagaatatatgataccttcttatagagggtataaggatgaataaataagagtcactgagtatttttctcggtgactctttgatttattttgatttttcaattaataactcttgctttagattccaaagtttaggtgaaagatccacgtaataagtatgaggattttcgaatcttaaaatttcaggccataactttgctgtttcttttttagaaaactttttaatatcaagaacagaaggcgaattatatacttgcttaccgttatcaaatatttttactaataaatcttttgcatagaaattagtaattctctttcttttccaagtatggataggatcgaaaatttctaattcagaattttcatcgattacttcatcatttaatgaaatgacatcagcaatagctatatctgtagttttatcaaataatctaaatacttttttgaaaccagggttggttattttttcgctgttttcactaatttttattttaggaattactgtagaatctttttctactgcaactagcttatatacgcctccaaatacaggttctgatttagctgtgattaacctttcgccaacgccgaaagaatcaatacatgcgccttgagctaatacatctcttattatgtgctcatcaagtgagttagaaactattatcttacaatcagaataaccagcagcatctaaagtttttctacactttttagtcaagtaagttatatctccagagtctattcttattcctgtaggtcttttgccaagaggtgctaatacttcatcaaatactttaatagcatttggtaaaccagattttaaaacattataagtatcaataagtaaagagcaattatcagggtaggcttccgcccatgatttaaatgcttcatattcggtatcaaataattgaacccagctatgtgccattgtgccaactgcagggatattaaaatatttatcagcaattgtacaggctgtagaatcacatccacctattatagaagctcttgcaccataaatagcaccatcatatccttgagctcgtctagaaccaaattccataacagttctacctttagcagctctacaaattctattagctttagtagcaattaaagtttgatgattaattgttaatagaatcatagtttcaacaaattgagcttgaacaacaggtcctctaacagttactaaaggttgattagggaatacaggatatccttcaggtatagcccacacatcacaagtaaacttaaaatttcttaagtaatctaaaaattcctcagagaaaagatttttgtcagctaaatatttgatatcactttcagtaaatgaaaggttatttaaatattcaataagctgatcaacaccagccattatacaatatccgccgccgtcaggaactcttctgaaatacatatcaaaataagctattctatcttgaacacctttactaaagtagccattagccattgttaattcataaaaatctactaacatagtaagatttctttcattagtaacatcaaatctcattaaattttccatatttatctcctttattgaaaaatacctaaagttattgtacaactatatataaattattacaatatagttatttatataataattatggagataattaaaataaatagcttaaaggagaacatatgaaaatattattagataattatcaggtaaatgctattaatataaaagataagaatactttggtagtagcagctcctggaagtggtaagactacagtgataattaatagagttaattatttgattgaagagcgaaaaataaagataggtaatataattgttattacctttacacgtgctgctgcagaaaatatgaaaacaagatataagaataattttaaaaaaactatagcgccgttttttgggacatttcatggattgttttataaaattttattaagggaaggttatgaaataaatataattgacagtggaaaggggcatggaattgtaaagaggatattaggaaagtattttgatgatgttaatgatgataagatacgagaagttctaaataatatttctctttttaaaacttctttaggaaaaatagaaaactttaagccgtcaatttcaatggaaatttttaaagaatgttatgaacattatgaagaatataagactaaagaaaagttatgggattttgatgacttatccataagagtattatatttatttaaaaataacaaaaatattttaaataaatatagagcgatatttaaatatgtattagttgatgaatttcaagattgtgatgagcttcaaatagaatttattaagatgataaatccacaaaatgaattatttgctgtaggtgatgaagatcagtgtatttattcatttagaggttcaaaaccagaatatatggttaatttctcaaagtcatttaataatggaaagaaggtctatctatcaacaaattatagaagtaaaaagaatattgtggatatatctaaaaaattaatagcaaataatttaggtagaaataataaagagataaactcttatgaaagtgataagggaattgttaagttctttaagccttacaatgaatttgcccagggagaagagatagcaaatattataaaaagttttgttggagaaaattacagcaataatgcagtactctatagaacaaatatggaagcaagaagtttaattgatacttttactagaagaaaaataccttttgttttattagataagggatataatttctttgagcattttatttgcaaggatataataaattatttaactttatctatagatccatttaatagagaagctttcaatacaattattaataagccctttagatatataagtaaaagtaatttaagttatgtttcttcatataaagaatataaaaatgtttttgatattttaattgataaaaatgatactcctccatttcaagcaaaaaagctagatgatttaaaaaaggaaattatatatcttaataaaatttcgctaggtagcgcaattcaatatataatttcttcgcttggatatattgattatttaagagagtatgcaaataagtttaatcaaaattttagcgatttagaagatgtattagaagaattaaaaggtgcagcagaaggttttaagacaattcttgaatttttaactcatgtagaaaatgttaaggaagagatagaaaaaagtaaggtagttcaagatggagttatattgagtacaattcatggcgtaaagggtatggaatttaaaaatgtatttattatagattgtaatgaagaaactattccacataagtcatcaatggaagataacttagaagaagaaagaagacttttttatgttgcaattactagagctattaaaaatttatatgtcttttcacctaagactataagaggtaagtttagtgatatgtctagatttattttagagagtggattagaagaggaaagtagagttatagattatggtattaaaagaggagatgttgtttatcacagacagtatggagacggtaaggttaaggctatagaaggagataaaataactttagattttaaggatgatataaatagaagtttttctttaagagtattaatggagaataatttaataatattaattaagtagttttatttaattaatatttatcattctggtaataatattaaatgatacggaaaatcttttactagaaggtaggagtagatatgaaaagatatataaaaattattaaagtattaatatttacatgtgctttgtttatagggataaacttatcgcagttatatcctaaagcatattcgccagaagaaggacaaaaaatagaggcatttatagataaaaatggagatttgcttagtggtgaagagaaagataatttaagcgaaatagtaaataaattaaataaatatgttgtattatcacaggaggaaagagaatatattagggaatgtgaattaaatgtaataagaaaaaagttaggagatgcacagtttgaggagtataagaagttaattgaaaaaagagcatcaggtgcagagttccagcaaccggaaagatttagattatatgaattggaaaaaatgttaagatgatacaaaaaatctataaataattaaactaattgaataaaggaaatacataatatataattaattcaataggcttatatttcaaatataagcctgtaaattttttgggggagaagtttataatgaaaaattttaatttagaagcacttaatattaaagatgagttaaaagaaataagaagaacgcttcatcaatatccagagctggggtttgaggaaacaaatacttcaagatatataaaagattttttaagtaaagaaggaattgagtttaaagaatttgcaaaaactggagtttgtggaattatcactggcactaaagctggagacaaaaaagttatagctttaagagcagacattgacggactaccaatgcaagataaaaagagttgtacatatgcgtctaaggtaaaaggaaagatgcatgcttgtggtcatgatggacatacaacaattcttttaggagctgctaagatattaaataaatatagggaagagtttagtggaactataaagcttatttttgaaccagcagaagaaactactggtggagcaaaggtaatgatagaggaaggcgtacttgaaaaccctaaagttgatgtaatgtgtggattacatgttgaagaaactattgattgtggaaatattatggttaaaaaaggcacagtaaatgcagcatcaaatccatttactattattattaagggtgctggaggacatggagcatatccagatactgcagttgatccaatagttatagcaagtcatgttgtaacttcacttcaaagtatagtaagcagagaaataaaaccagttaatccggcggtggttacaattgggagtattcatggtggaaccgctcagaatattattccaagcgaagtaaagttgtcaggtattattagaactatgactatggaagatagagagtttgcgaaaagaagattaaaagaaatagtaaatggagtttgtacaaccttcagaggaagtgcagaaattgagattgaagaatcttatccatgtttatataatgatgatgagatggtggaattattagaaaaaagcgctaaggaaataatagggcaagaaaatgttaaattacaaaagaaccctaaattaggtgttgaaagctttgcatattttgcaaataaagtaccttctgtattttatttcttaggaataagaaatgaggcaaaaggaataatttatccagcacataatagtttatttgatattgatgaggatgcattgccaattggcgtagcaattcaatgtgaaattgcattaaattatttgacaagataagaaaataatattaatctattaaaatgggtaaaatgacaaaaaaatagactatttacgattatattaaataattgtaaacaggtcatacaatataggagttggttttttgaaaattgaaataggaacaaatgaagcaggacaaagattagataagtttttaagaaagtatttaaaggatgttccattaagtgctatttttaaagctttaagaaagggcgacattagagttaatggagtaaagaaaaaagaaaattatccattagaatttggggatgtaattgaaattagatatttacaaagtaagcaagagaaaaaagaagacacatttattaaagttaattcaagtggacttatgattacatatgaagatgaaaatattttaattgttgaaaaatggccaggtgttttagtacatccagaccaaaaaggtgcagagccttcacttacagattatgtattatcttatttaaatgcaaaaggtgattacttgccagaaaaagaaaaaacatttacacctgctccatgtaataggttagatagaaatacttcaggagtagttatttttggaaagaattttgaagcattaagaaatatgaacgaaatgattagagaaggtaacgttaagaagtattataatgcattggtaaaaggtaaaattaaagatggagtatataagggatatatttcaaaggatgaaaatgaaaatatatctaaggtatatgatgaaaaaagacctaatactaaggaaattgctatggaagtaaagacaatgcaaactaatggagcgtactcattattagaaattgaccttattacaggtagaagtcatcaaattagagcacatttaagccatttaggaactcctattataggtgactttaagtatggagataaaaaattaaattcattctttgataataaatttggattaaattatcaattcctttatgcttataagcttatttttaagggcgctaacggaaaacttgaatatttaaagaataaaacaatagcagaagcgcttccaccaatgtttaaaaagattaagaaggaagtatttaaatttactatataagatcataaaaggggatagttatggaagagaaatcagtgggtcgtagttttcttatcttatctgtagcagggatacttgtaaaaataatgtcagctgcatatattccattattaagggccataattggaacaacaggaataggaatatataacgcaagttacagttattttgtttttatattagctattacaagcttaggagcacaaccagcggttgctaaggttgtatcagagttaagggcattagggcatgaagaagatgcattaagggcaatgaaattagcaagaaggtatttagctattatcggtgctattattacaatagcatttatgttccttataggacctattgctaaagttactaaatgggaaacagcaacactttctttaatgtttttagctccaacagtgttttttagctgtttattagctacatataggggatatcttcaaggtatagaagaaatgaagactcttgctatttcacaagttatagaacaacttgttaacgtagttttaagtttaatatttgcttttgttcttgttgggataagcattgaatggggaagtgctggaggtactgtaggtactactataggtgcaattgtagcgcttatatttattttaataatatatgatagagatagatttgaagagagagcagaagaggaaaataaagcagaaaaacatattagtgacaaaatgatacttaaaaaacttgttaagtatggggtacctataataatggtagctgcattacaaaattcaagtggtatgattgatactataaatgtaaaaggtaggcttcttgcagctggctttaatgataatagagcaactgaattatatggaatactaggatgctataatacgttgctttatgtaccattatcaatggtaacagcattaagctcggctatttttccaagaataataaatgcatttacaacaaagaaaaagaaagagttaaaatcacatatagcatatagctttagattaacttatttaataacaataccagcagcagttggattatcaatgttaagcaaagaagtttatattatgatttatggtagcacagaggggtatgaattattaatgtatgggtctgttgtattgatttttatgtcaatttcagctatacaaaatactattcttcaaggaataaataagttatatttagtattaagtactgcttttttaagtattgtaataaagttcggtattaactatttcttagttggaataaaagacattaatatattaggagctgtatttgcaagtttctttgcttttttagttcctgtaataataaatcacaatagattaagaagaatatttaaaatgagaatacctatatttaaaatggctttagttccattaatagcttcaggtattatggcattaagtatttcattatgtaaaataccaataaatagatttatgaatatagttcaaggtgggagaataataacatcaatagtagctttaatattgatagctataggtggtgctgtatactttgtaactatgatttttcttggtgatataaagaaaaaagatttagatatgatttcacctaagatatttactttattaccaagatttttacgaaagaatatgtaaatattataaaagctaaaaggtctgttacatctaagtaacagaccttttagtttttatatattattaacaactataaattggtgttttcctcgtctttttgctccacacattgcgtggttagcactttcaattaagaagtcagccatagtactacaacttgtcatattcattgttattatatattaagtgtaatttcattattaatcatttctccagaagagttagttaagcataaataattttacaaaagtagataaggattttggagattgtataaggaaaggattaaaaatgtgaagatttcataaaaaataaggtgaaaaagcttaatttcattcagctttttcaccttatttttaatattcatctattccgaacctacttaagtaagcaaatattccgaatgtaaataatattattaatatatttttaaaataaaataaatttgttagtagatacttattggctaaatttaaaattaggaaaagtaaaattcctattaaagaaaatataattatattaaatagagataaatttaattcaatatgcttctttacttcatgcaaattaattattaaatttaaagttgaagtaacgaatatagtaattacgtaagaaaaaatatttatacttggtatagctgtgaaaaagtataagcataatatttctgtaacagaaactattattgaatttcttaatataatactttgtctattaagtccatttaatattccaaccattgtgtttgagacaaaaaatataggagctgaaagtgaagatagcttaatgtatagacctaagtcatctctgtgatagaacatttctccaagagaatctgggattagttgacaaattatagtggttgccattccaagtaaaaaagcaatctttaataccattcttattcttacagaggcattgtaatactcgccgttacttatagtttgtgataagtctggtacgagaagagtatttattgaatttacaacaattaatgggaaagtgactatggttaaggccattccattaaacttacctattaagtttaacgcggaactataatctaaaccagaagcaacaagttgtcttggaacaactaatgttgaaattgttgaaaaagcatttcctaaaaatccatttaagcataaaggtaatgaaattataagaacattaaataatagttgagcttttctttctggtttatcatgcccgataggcattcgtttttttgtatatctaaaataaacataaagtaataaaagactttgcaattctcctatggctagagacacaaaggctaatgttactattgaagttaatgtttgagctttaaacatatatataagtaaagttatagttatgattctcattgctttttcagagatgtcaattacagcaggaacagtgattttagatgttccgtagaaaaaaccttttaatatatttgaaagcgcaataaaaaccatggcaggacaagtaactcttaaggcgtttaaagttctaggatccttaattccatatttacttatgtaaggtgcaaggaaaaatactataattccaataattactgcccatattatgttaaaaaaagcaacacaattaatagttttaaataaattattatactctccagtggcctcataaatagcagagcgttgagaaatagctgcaattattccagcggtcattaagcaaataaataagttgtatactggcataactaaaccataaatagcaagaccttcaggacctgcaatatttcctagatacatagagaaaataaatcctagtattccggttgtaatgttagatgcagttaaaaaaaatgaatttttaaagaaattatctttttccaaattattttcctcctgttgtaaattatttattaaacataaaatatacgaatacgaattaagtaatatagtaatattcagtaaagttgaattacattaatacttattcagtaaaataaaacaatatgatattaaagagcattatttaaatataagtaatattttgttatgtaaaaaaataaatttattatgaaggggtgaggcgtatgaagaaatttttgcagtttataattttatcagttgcgatagttagtatttcttttggaatttataagtttagcaaaggatatgatcttaatttaatttacaaaaatattgattggtcaattacaaataaatcagtagaaggagcagtatcatttgcatttgacagagataataacttatacatagcttttaaagatacaataaaagtagttaatgaaagtaataatgaagaggtattaatatatgataagtcattaaatatatatgatattgcttgcagcggagattctataattatagctacagataatagagtgatagcttatgatttatcaagtgaggaatttagagatataataactgggttgcccaatttaggaataaacaataagactaatcttactttgaaagatgagtatttatatataactataggatcaaatacaaatgcagggattgtagatgaaggaaataaaaatgaggacatagcttcttttgaatggatatcaactggtattggatataatggcaattatgggtttgctaaattcggacaagtagtaagttcaggagataaaataaaagagggagtattaagtaatgcttcaatattaaaatataatttaaatactggtaagttttccacttatgcaacaggaattagaaatgttgaaggaatagctacaaatagtatgggtgaattgactgcaattgtaggtggaatggatgaagaggggggaagagaagtaaaggatgatgttgattatatatatgatataaaagagagggcgtggtatggatggcctgattttagtggtggagatccaatcacttccccaagattttctgatggaactaataaattatcatatattattgagaatcatccaacagaaataccattgccgcctagatatcaacataacagtctacaatcactaagaggactagctattgattatgaagggaagtgtttcccaaaagatactgtgatttttgctgataataaagaaaattatgtatatgtattaactgaattagggacttcaaaagctatcgtaagtttagataaaaatagctatatagaaaaaataagatataatgattcaagtatatatttattagatagtaaagctggatgcatatataagattcaaggtcagagaaatgatagttcgtttaatttgcccaacattgtttggatttttattgctatattagtaattgctattgcaatgactattatatataaggttaaaaataagaggaaaaaataaataaaattctaaaaatatcttatggtaattccataagatatttttttgtattattatatataaagaaggaaagataaaagcttaaataccaaaagaaaaataattgttcaaaaatgatttacataagttgaaaaaaataataataaaatttattaaaagaaaaaaataatttataaaaaggagagtaaatatgggtaaaacaattatattaaatttaagtggtattaagttattaggtgatgtactagatgttggtgaaagctatggagtaatttataacatttctaaagatacgattgacgaagtttgtgtggatctattagaaggaagtatagatgaaaaaagtatacaaggtgagtatgatgtatgcactatatttttttacttaagcaatttatggagagaatcagcgcgtattcaattgataaatgaagtaagtaaattaataaaagtcggtggagaaatatatatttgggatataaataaagagatgggagaagtatcaaataataaggtaatggcagtattgccatctggtaaaataaaagagtttgagtttaaaaatttaaatcctatttctacatcaaatatagataacactaaaaaaatgttaggaaatatgtatagtattaaggaagagaagctttgggaggatatattttttattaggggagaaaaaataaagtaacgaaaggaagaagaaagtgaaagttttattaacagcaattaactcaaaattcattcatagtaatttagcagtgaggtatctaaaggcatttactgaagatatggattatacatgcaaaattagggagttttcaattaatgatagggatgagaaagtacttgaagaaattataaaggaaaaacctgatgtagttgctttctcaacatatatttggaatgttgagatggtaaagagattatctaatcttataaagatagtaaataaagatataaaaattttatatggtggaccagaggtatcttatgacagcttaaatatattaaaggagcttaatggtgattatttaattgaaggagaaggagaaaagacatataaggaatttattgagtattgtcttggagaaagagatgttagaaatataagaggattatattttaaagagggcaatgaagtaataggaaatggtaatagaccacttatgagcatgaatgaaatagttttcccttataagatggatgaagatttagataataagatagtatattatgaggcatcaagaggatgtccatttaactgtaaatattgcctttcatcaacaactcatggagtaagatttttagatattgaaagggtaaaaaaagaattgcaatttttcatagataaaaaagtaagacttgttaagtttgtagatagaacttttaattgtaatttcaaattttcaacagctatatgggaatttttaattaatgctgaaacaaaaactcaattccattttgagatatcagcagatattttaaagccagaagaattagagttgttaagaaaagctcctaaagatagattccaatttgaagtaggagttcaaactactaatgatgatgtgctaaatagaattaatagattcgttaattttagtgatattaaagaaaaggttgttgaattattagaaattaaaaatataaagcagcatttagatttaatagcgggattgccaggtgaggacatagtatcatttaaaaaatcatttaatgatgtatacagtattgaaccagaagagatacagctaggattcttaaaacttcttagaggatcctctatgagagaagaagcagaagaatatggaatgaaatattcaccttatccaccatatgaaataatctcaacaaaagatatttcttataatgagcttttaatattaaaaaaggtagaaagtatggtggataaatattacaactcacagaagtttaataacataataaaaatattagttaaatgctttgatacaccttatgatttttacttagaattagggaattactttgataagaagggatattttgatagaaatataggtaatagtgaatattataaagtatttttagattttaatatggaaataacaaaattagataataaaatattacgcgatatagtaaagtatgattacttaatgttcaataaaagaagaggaatgccagaatttttaggaaaaggagttggaaaagaaaaggaaaatgcatttaaagatatattaagagaaaaatactcctttaaagactattatatagaagttttttgcatagatataaataaatttataaagcatggcgaaatagaagaaaagcaatcatacttcttatttggatatgatggagaaattatagaaattgatgatttagttaacataaaacaaaataagtaaattataaaaaatagtggtaaaaaaacataacaaataaataattattataaaattagagcgttgtttaggaaatattaacaaaaaaaagttgaaaaattgtaaaaaacgtgtataattaaaaaggaggtaaaaagtaattaatactacataaagtattaatatttatattatccgacttgtatatagtaaaggtggtgagactttggcattagaagcaattaatgagataaaggaagctgagaaaaaggctgaaatgataatttcagaagctaaacaaagtgcaaaagaaattgttagcggtgctactaaagaagcagacatcaaatatgatgaaataataagcgaagcaaaaacaaaagctaataacctattaaatgctgctttagaagaaggaaatagcaatgcagaaccgatcttaaagatgggagaaaaagaaatagaggctatacgtaatatgtctcaagatttaaaagataatgctattaatatagttgttgagaggatagtgaagattcatggcaatagttaagatgaacaaattcactttgcttacttttgaatctaaaaaagaagaacttcttcgtaagctacaaggtttttcaaatgtagaatttataaatctacaagatgaaaatttattagaagctaatgaagagttaaaatctttaaataaagatgaagtagattcaaatattgcaaagtatgaagaagatttatcaaaggctaaaactactctagactttttaactcactatatgcctaaaaagtcaggattaaaagcattagaggatgacaaggaaaacttaactattgatgaattagaaaatgcagttaaaaatattaactggaatgaaatttatagcaaagttaaggaaaaggaagatgagcttcacagcatagaaagcaagattactaagctagaaggcgaaattgaagttttaactccatggcaagccttagatatttcttttgaagctctaaatgagctagatatggtatcaacttttgttggaagtatttcaaagcaatatgagggacaacttaatgaaagtctagatgctgagtatgttgaaattatttcaagagggaataacgacataaatatattagttgtgtctttaaaagaaagacatgatgaagtattaaatcttttaagaggatttggatttagttcatttaaatcagagtatgatgaaataccacaagttgttataacaaatcatgctcatgagatagaagaattaaaatcaaaaatattctttgtaaaagaagaaatagcttcctttgaagaggactataagaaaatgaagttagtttatgattatcttacaaacatagttttaagatataaagcttcaaataacttcttaagaactacaaacactgttgctattcaaggatggtgtgaagtagaaaagaatgaagaattacaaaatatatgtaaagaaacattaaatgatgactattatatatcatttgaagaagtaaaagaagatgaaattgaagcagttccagttaaattgaaaaatggattgcttaacaaaacatttgaatctgttactgaaatgtatagtttaccaaaatataatgaagttgatccaactccattattagtaccattttacttaatattctttggtatgatggttgctgacgttggttacggattagtaatgttaatagctgcattctgtgcaatgaagttcttaaaattaaataagaaaaatgaagatttcgctagattcttcttattcttaagtataccaacaatagttattggattaatatatggatcattctttggagatgcagttaaaataccaggattaataaatccaacagaagatgtaaacactcttttagtggcttctatagtatttggggttatacaaatattctttggattatgtataaaagcatatacacttattaaggcaggaaagccaaaggatgcattttatgatgtaggttcatggttaattactttaatttctattggagtattagcaggaactataatgctaggatggccatcaattgttaaatatattgcaatagcagctatgatatttggtatgcttgtaatagtattaactggtggtagagaagaaaagacaaaaggtgctcaaataggtcaaggtttatatgcattatatggaattacaagttatattggtgatttagtttcatatacaagacttatggcattaggtttatcaggtggatgtattgcaggagcattaaatttattaatgcaatcattaactgggccagcaataatattattaccatttgtgttcatcgcagctcacgtatttaacttattattaggtttattaggagcatatgttcacacagcaagattacaatacgtagaatatttctcaaaattctacgaaggtgggggaaaagcctttactccatttaaagcatcagaaaaatatatgaatttaaaggaaaattaggaggatttgaaaaatgaatacatggatacaattttttatggaaaataacggtgggttaatatttgcagctttaggtgttgcattagcagttggtttatcaggtataggttcagctaaaggtgttggactagttggggaagcagcttcaggattagttacagaagaaccagaaaagtttggtaaagcgttagtattagaattattaccaggtactcaaggtttatacggtttcgttgttggtttcgttgcttacactaagatgtcttcaggaatgtctttagagcaaggtttatacttaataggtgcttgtttaccaatcgctttagctggtttattctcaggtatagctcaaggtagagttgctgcttcaggtatccaaatattagctaaaagaccagaacacaacacaaaaggtataattctttcagcaatggttgaaacttacgcattattaggattcgttatatcattcatgttagtaagcatggcaatgtaattaatacatgcaatattattagcatcataaagattggagatatagattatgtcaaatgtaaagaatataacttctaaaatccttaaggatgcagaagctggaaaggaaaatatcttagcaactgctgaagaagaaaagaataaaattctttctaaaaaagtaagcagtgcaaatgaaattgcacaagaaattttagaaaaagctgaagttgaagcaaaatctaaaaaagaaagagtaatttctagtgctaaattaaaagttagaaataacaaattagcagctaagcaagaaattatagatgaagttttcgaaaaaagcgtagataaattaacagaattatctaaagaggaattcttaaactttgttaaaaatacaatttcaacaatgaatttaactggaaagcaaacattaattttaaatgaaacaggattaaagtttgtagatgcagattttgttaaagaattaaattcaaaagtaaaagcacaaatcactttaagtgaaaaggctggtaactttaaaggtggtttcatcttagaaaatgaaggtatagaaataaatagcacttttgaagctctagtaagctcattaagagatgagttagagttcgaagtggcgaaggtgttatttaattaaggaggggtagtatggatgtaatgcaatttactcaagctctttcaagaatttgggtattggaaacaagactccttgataaatctaaagtagagagaatgttagaagctaattctgctgatgaagttttaaaaatacttggtgagactgagtatgctaatataatgggtaatgttaaaagagctgctgattatgaagaaattttaagtacagaacttaaaagagtttataaattagtttacgaactttgcccagtaaaagaaatagtagatctaatgagcattaaatataaataccataatattaaggtgttattaaaaggaaagttcttagataaagatttttcaaatatgttaattgatttaggtaaggaagacttaaatgaattaaaaagaaaaatagatacagataattttagagatttaaaaggaaatgttgaaaaagcagttttagaagttattgctgattttgaagcaaataaagatcctcaaaatattgatataattgtagatagatatatgtttaaagagttagttgaaataaagaaatctttaaattataagtttacagataaacttgtaaatgcaattattgatgctacaaatgttagaactttactaagaattaaaaagcaaggtaagggaagagaatttgcatcagaagttttggttagtggtggatctataagtaaagatacattagtagcaatcattaatgaaacaccagaaaatattatttctaaattaagcactagtacttattcagatttaataaaagaaggtgttgaaggctacatagctactaattcagcaaatcttttagaaaaattaagtgataattatattatggatttaatgaaaagcggtaagcttgtaacatttggaccagaaagaattttatcatatatttatgctaaagaaacagaaataaaaatcattagaattataatggttggtaagcttaataatattgctgaggaagtaataagagaaaggctgcgtgatatttatgtataagaaaatcggtgtagttggagataaagactcagttttagcattcaaagctattgggatagatgtatttccagttgtagaagctgatgaagctagaattgctgttgatagaatggctatgaatggatacgcagttatttttataacagagcaagttgcagtaacaattgaagaaacaattgaacgttacaataagcaaatgcttcctgctgtaatattaattccaagtaatcaaggaactttaaatataggttcaaagagaatcagcgatagcgtagaaaaagctgttggtgtgaatattttataggaaggcaggttagaaatttgaagaccggaaagataatcaaggttgcaggtcctttagttgttgctgaaggaatggacgaagcaaatatttatgatatggttaaggttggagaaaagggtcttatcggagaaatcattgaaatgagaggcgataaggcatctatccaagtttacgaggaaactacaggaatagggccaggggacccagttgttacaacaggagaaccattaagtattgaattaggaccaggacttatagagtcaatgttcgatggaatacaaagaccactagatgcatttgaaaaagtagctcaatcaccattcttaacaaaaggtgtatcagttacttcattaaatagagaaagagtttggacttttaatcctatagctaaagttggggataaggttgaagcaggtgatgtaatcggaacagttcaagaaacagctgttgtattacacaaaataatggttccatatggaatagaaggaactattaaagaaattaaagctggagactttacagttgtagatacagtttgtattgttgaaactgctaagggagatagagaagttcaacttatgcaaaaatggccagcaagaaaaggtagaccatttgcacaaaaattaaaaccagaagcaccaatgactacaggacaaagagttatagatacattcttcccagtagctaagggtggagctgctgcagtaccaggtcctttcggagcaggtaaaacagttgtacaacaccaaatagcaaaatggggagatgctgaaatagttgtttacgttggatgcggtgagcgtggtaacgaaatgacagacgttcttaatgaattcccagaattaaaagaccctaaaactggtgaatcattaatgaagagaacagtacttattgcaaatacttcaaacatgccagttgctgccagagaagcttgtatatatacaggtataacaatagctgaatactatagagacatgggatattcagtatcaatcatggcagactctacttcaagatgggcagaagcattaagagaaatgtctggtagacttgaagaaatgccaggggatgaaggttacccagcatacttaggatcaagacttgctgactactatgaaagagctggtaaagttgtatgcttaggtaaagatggaagagaaggagcagttactgcaatcggtgcggtatcacctccagggggagacctttcagaaccagttactcaatcaactttaagaatagttaaagttttctggggattagatgctcaacttgcatataagagacacttcccagcaataaactggattaactcatattcattatatgctgatactgtagatggatacttaaataagacagttgctgaagattggtctacattaagacaagaagcaatgactttattacaagaagaatcagctttacaagaaatcgtaagcttagttggtatagatgcattatcagaaaaagatagattaaaattagaagtttctaagtctataagagaagactatttacaacaaaatggtttccacgaaatagatacttatacttcattagataaacaatacaaaatgttaaagcttgtattattattcagaaaagaagctgatagagctttagatgcaggagtttacttagataagatattaggcttagaagtaagagataagattgcaagaagtaaatatatccacgaagacgatttagctaagatggatgatattgctgctgaattaagagctgacattgatactttaatcaacgaaggaggggttcttaatgcttaaggaatacagaacagttacagaagttgttggtcctttaatggttgttgaaggagttagtggtgttaagtatgatgaactagttgaagttgaaatacaaactggtgaattaagaagaggtaaggttctagaagttaatggaacaaaagcaatggtccaattatttgaaggttcttcaggtattaacttaaaaggaactaaggctaaatttttaggaaagccacttcaattaggtgtatcagaagatatgctaggaagagtatttgatggaatgggtcacccaattgacaacggaccaaagataataccagaaaagcaattagatattaacggggaagcaattaacccagtatcaagaaacttcccatcagagttcattcaaacaggaatatctgcaattgatggattaaatacgcttgttagaggacaaaagctaccagttttctcagcttcaggtcttccacatgcacaattagcagcacaaattgcaagacaagcgactgttttaaattcagatgctaactttgctgttgtatttgcagctataggtattactttcgaagagtctcaattcttcgttgatgaatttaagaagactggtgctatagataatgctgtattatttatgaaccttgcttctgacccagctatcgaaagaatagctacaccaagaatggcattaactgctgctgaatttttagcatacgaaaaagatatgcacgttcttgttattatgacagatatcactaactatgctgaagctttaagagaagtttctgctgctagaaaggaagttccaggtagaagaggttacccaggttacctatatactgacctttctacattatatgaaagagcaggtagaattaatggaagaggtggatcaatcactcaaattccaatattaacaatgcctgaagaggataaaactcacccaattccagacttaactggatatatcacagaaggacaaataattctttcaagagatttatataagaagggaattatgcctccaatagatgtattaccatcactttcaagacttaaagataagggtatcggtaaaggaaagactagagaagaccatgctgatacaatgaatcaattattctcggcttatgctcaaggtaagcaagctaaagaattatcagcaatcttaggtgaatctgcattatcagatactgataagaaatttgctaaatttgctgaagcttttgaagaacaatatgtttctcaaggatttgaagctaacagatcaatagaagaaactttaaatttaggttggaaattacttaagattcttcctaagacagaacttaagagaatcagagatgaatatcttgaaaagtatatgccaaagggagatgaagagtagaatatggcaaagttaaatgtcaatcctactagaatggagctatctaagctgaagaagagattatctactgcagcgagaggacataagcttcttaaagataaacaagatgaattaatgaggcaattcattaatcttgttaaatataataatgaattaagaaagtcagtagaagctgaattagagggttcatttaaagatttcgttatggcaagtgctgtaatgagttcagaatttttagaagaagcagttgcttatccaaaagatagtgtatctgttgaagtaggaacaaaaaacataatgagtgttaatgttccacaaatgaaattccacagacaattacaagatagtgaaggaagcatttatccatatggttttgccaatacatcttctgaattagatgatgctataggaaagcttgaatctatacttcctaagctacttgaattagctgaagttgaaaaatcaactcagttaatggctgatgaaattgaaaagacaagaagaagagttaatgcacttgaatatatgactatacctcaattagaagagactattaagtttataagaatgaagcttgatgaaaatgaaagaggagctttaactagattaatgaaggttaaagatatgattaattcaagagcataatgatttaacattatcacaaaaaaggagctgttttaaaataacagctccttgctttttacattaaactattctataggggtaaaattaaattttttcattttattaagattatattatgtatttgataatagaaagaaataatagtataatgctaatagaatacataattgtacatattatgtggaaatttaaggagaaattcaatgaagtatttaatagcgacagttttgtctttttcaatagtatttattttgacaccaatattaatgaaattggcaattaaatataattttacagataaaccaactaagagaaaaaaacatagaggaccaattccactttgtggtggtatttcaatgttcatcggcttctttataccttattttatagtcttttatgatcatccatttaaagagaagtatggtatttttataggggcactattgatattaataataggagtagtagatgattattataagagtattggtaaagagttcgctattgcgccaaggttaattgtgcaagtattagcagcaataattgtttataagtcaggagtagcttttcatggctttactaatccttttactaatacatatgttgtattaccgggtattattcaatttatattaactataacttggatttttggtgttactacagtaattaactggtctgatggtatggatggcttagcaggaggattatcctttatatcagcgatgacttttgcagcatctgcagtaatattagcacaaccaccatcattattattttcattaatgactgcaggagttgtattagcatttttgttttataataagtatccagcaaaaatattcatgggagattcaggggctaattttttagggtttatattaagtataatagctttagatggtgcatttaaagcagcaacaatattaagtttattaattcctattttggcattagctgtaccgatttttgataatatatttgtaatttttaagagattttcggaaggaaagcctgtatatcaggcagatagaagtcaattacattatagattagaggccaaaggattaaatacaaaacaagtagttacttttataagtggaataagtttagcatttagtgttatttcaattttaatgctattaatataatggaatttaatagtaaaaaaataagtatttacaaaatgagaaaaattttatataatttaattaaacttatcaagagtggtggagggactggcccgttgaaacccagcaacctattaacagttactagttaaaattagtagttacattgaaagaaattatttaaaatttctttagtaaactattaactaaaaactattaattattaactatattaatgtggtgctaaatccaacagcaacagctgagagataaggatattttattgggaaacatgtttataatacctaaaggaaatatcctttaggtttttttattttattaaaaaaataataataaagaagtttattgtgtgtatattaattaagacaaggactttttataaattttaagggggctatttaaatgaaaattgatgaaatatttaaaaagaaggatttggtgttttcttttgaaatttttccacccaaaacaacatcttcagtagagactatttataaaaccttagaagaattaaaggatttaaaaccagattttattagtgtaacatatggggcaggaggaagcttagtaaataataaaacaatcgagctatcctctttagtaaaagaaaaatatggagttgaggcagtagcacatttaacttgtataaattctactaagggtgaaatagactatattttaaatgatttaaaagggcatggaatagaaaatattttagctttaaggggagatattcctaatggtggaattttaaagggagattttaaatatgcatatgaacttatttcacatataaagaaaagaggagattttaatatagcagcagcatgctatcctgagggacatgttaagggtaagaatctaaaagaagatttagtacatttaaagttaaaagaggaaagtggggcaactcattttatatcacagttattttttgataataactatttttataattttctagaagaaaaggataaattaaatataaagtcttctattgaggcaggaattatgcctgtaactaataaggcacaaatagaaagattaacttcattatgtggtgttaatttaccagaaaagtttataaagatagttaataagtatgagtatgatagagaagcattaagagatgctgggatcgcatatgctgttgaacaaatagttgacttagtttcaagtggtgtggatggaattcatttatatacaatgaataatccatatgtagctagaaaaataacagaaagtataagttcgataattaattctataaataaagaaagggtagtttaggaggttttagaatggagaaagtagaaagttttgaattagatcatagaaaggttaaagcaccttatattagaaaatgttgtacactaaatggaccacaaggtgattttgtaacaaagtttgatattagatttttacaacctaataaggaagcatttggtactgcagctatgcatggattagaacatttgttagcacatgagttaagaaataatttaaatggaataatagatttatctccgatgggatgtagaacagggttttatttaagtatatttggtgataggaatgcaagtgaagttaaagtagcacttgaaaaagcattgaaaagtattttaaatgcaaatgaaattccagcagcaaatgaaattcaatgtggcaactatagagatttatcattgtttggtgcaaaggagtatgctaaagaagtattaaataaaggcttttctttaaatatatatggtgagtaaagaaattaaaatagttagttttaaaaaataattataataatttatcaagtaaaacaattaatttaagagtaagaatagattcacttatttttataaaatattaagtatagtaataaattttttaaatattatgaacaaaaggccagtttttactggctttttttattgttatttttagcttgagtttgaatgagaaaaaatttttctacttattaaatatctatatttttttagcgtaatatggttattattttatataattcatatatggtgctataagttggataaagtaataatttatagataatgtggaaaaacgtctaatattgtattataataatattatatgcgtttttgggaggggcgaacatgaatatattattagttgaagatgaaagaattcagcgtgtggcacttgcgtctattattaagtcaaatttcatcgatgttcgaatatatgaagctgcatcacaagctgaagcaataaagatagtgaatgaaaaagatatacatctatttttcattgatattcaattaaaagattcttcgggattagaattagcaaaaaaaataaggcagtacgaacagcatgctttgactggaatagtatttgtaacaggagagcttatacatattatagaagcatttaagagtattcattgttatgattttattgtaaagccttataaggaaaaggatatcatcaaaattattgatgtatttttaaattcatcacctttaaagagtattaaagaaggagcttatacatttattgatatagattccaatatatcagttaaattatatcataatgatattatttatattgagtatagtgataagacttgtgatatacatactatttcaggcgtatatagggtcaaaagaacttctttagctaaggtactaaaaaatataaatgatgataatattattcaaactcatagatcttttgcagttaatcttaagtatgtaaaagaaatagagaagacctatgaaaaggtgtggaacattaagttaaggtcatgtgaggatattgctttgttaagttacacatatagacaagcattcttaagggggattgaataatggaaataatggctttagcaatttcgtttattgagatgactgctatatttttaatatataacgttttaataaatgaagatattaaaaaaaatatatgtaaaaaaatattgttttctgtagtgatttctttgatatattttgtatttactaatatatatgatgcagattctttaatagttcttataggaatattatttttaaattctatgataataggtaaacaagaaaataaagatacaatagtaacttacattgagtttattgtcagttcaataatattattaggagttgaattagtagttagtttaattgtatatataagtatgggaagtgatgatttaagtccgtttatgtattttattatattagtatttgcaatgtctatagtagtatacatacttagcactagtaaagctattaaacaaatacaattctctaaattcttttcaaagtataaaagtataaatattataattttgaacttatttgtatttttcctatttataaaagttttaatgagcaataaaataatgaatacgaaaattataataccaattacaattttagggttaatacttataggggtaaattgttatttttatatatacctatataaaatgttaagtgaaaagaaaaaaaaggaaattaagaagtcatttaatccacttattaatgacttaataaataagttaaaagcaaatgaacatgaatataaaaatcatttaaatactatttggagtatagcacaagttactcatcctgaagaaattaaggataagttgaaagaatatataggaaatattgttgatgatacagaagagttttctatgttattaaatattgaaaataccataatcaaagctgttttgtataataaagctcaaagagctgaaaaattaggggtaaaatatacttacaatgttttgagcgattttaaggatatacaattagataattctgaattaactgtaatattgagtaatttgctaaataatgctattgaggcaacttcatttgttgataaaaagaacgttgaaataaatatatttgaagatgagaaatattataaaatagaagtgaaaaattatactaaaaatttaaggtcagaagatttaactcagatttttaaagtaggttatacgacaaaaggagaaggtagaggatatggattggctaatgtaaaagctattgtagataagtataaaggtaaaatacaagttgcattagaagaaaatattgttaatatcactattttatttttaaagtgataaatgaattttatattaaaatgtttcgtggtaataagtgtttatatagtaaaatttatgattaaatatatgtgataaaaaatacaactagttctattattcaatttagctatattatatgctaatcatttaaggaagaaacctatttgcatatttaatatcctaaagttaatattttttaataattctaaaatccaattctattaagatactattattggtggtgtagaattctcctaatgttttatttattagtatttgctttaatcttagctttataaatatatttttagagagtattttatctgatttacttagttttactacaaatagagaaaaataaatttttgaaacaattatttgaattttaagttataactttacaaatagtagaatggcttagaagtggttaccctgtaatagccatataaaatttatatctcttacatgctttctctatttctttggaactttagatattactcaaatttgcgtaaactaatataataatagaagatttcctaggagcactattagtttataattctgaatattctactgtacttaataatgttactgaagcttcttttggtattataatttctaaatatattggtaacgctgtataaactaactaggtttataatttaagttaatacaaaaaaaggtggattctattgaatctacctttttccatttaatcgcctaattacttttgtaatagctactttgttttattagataaattaattattttttctccattggtggagttggctctccccataagaaaagactatttggagctgataatgtcataatatctgaagttgttgcagtaattaaacacattaaggcagctaatttaactataaatttttttttcatgtttataaacctcccataaaaaatctattattatataaaaaattattagtaaaccacaattgatgtaatactgtggtaaaaatatattagaaataataaaccacattaatagtataactgttacaaagtctttaaatttcaatttattatattgagtatgaacggtttttcttaatggattaataggtttaaatttccttattaccacaatgcataataatataaatgtaaattgtaaaattatatttagtgaaggcatcaaataggctgagtaatatattaaaataaatgataaattactttgaaccatgcaactcatgtagctcttagcatgacttccaccgatataaggccttattaacattaataaggtaatcatcaataaaaatgctaaaaacttgtccaaaattaatgaaattaaaatcataacaattaatttagaaaactcaccataaaatacttctaaaccatatctaattttatcaatttcataaatatcagttattcctacattagtaacaataaaatctaattgtttttttataaacttattactcaaaaatatacctccttaagtactacataaataattataatataaaaataaatgaaattccattaaaaccataactttcattaaaattagtataaaatgaaagaaaaaaagaaaaaaagaaaaaatatacgtaaaattttccgaaaatgaacatactcatacattataaagtataacagtaaaaagtatctttaaataaaaatgaaaatatggtaaaattttatcgaaaaaggagggctgtaatgagtgtgatatttacttttattgaagctataactatgataatgatttattgcatagtttttttaggggaaaaagataatttagctaaatatttattgaaaagttttataatttcagtgatttctacaggggtattttttatacttaataaaattgaaacatggaatattgtaagtttgctaataacgcttataacaatttctttgataatgagtaaaatttataacaaaaatattattatatgcattatacaatttatttttacatatgtttttgtagcgattttagaatcaatatatatgatattgagcattagattcttaggtgatttatatataacaggaatgtacttatttgttgttattatttattttatttgtgttatttatttaatttttagattaatgaagaataaaaaatataatcttgataaatttagtgagtttattagcaattataataattttattttagttattattaatataggaatatttttatttctttatagaacattacttagagatagttgttatgggcaggaaattattttagaaacttcagtgctttttgttgctatgatcttaataaatgtattttatttttatgatgtttataaaaaagataaaaagaaaaaaagttcagaaataaaagaaagtatgaatcctcttatacaagagctaatagatgaaatgagagctaatgaacatgagtataagaaccatttaaatatactatattgtatgatacaggtatgcaaagaagatgaattaaaagataaagctaaaaagtacataggtaatgtttttgaaaataaaaatttattaaataatttatccaaagtagaaaatacaattttaaaagctgtcttattaagcaaaataaatcaagcagaaaaaagtgaaatagattgctattattttattgatagccaacttgaaggattacctttagatgatagtgagcttacagtagttttaagcaacttattaaataatgcaattgaagctgcaagtaagagtgagaaaaaagtaattgaaatttcaactgagtattatgaaggaaaacacataattgaagtatctaatagtgtagataatcttacaaaaagtatggtagctgatatttcaaaaataagattttctactaaagggacaggccgaggatatggtttatataatgtcaaaaatatagttaaaaaatataaaggtaaagttaatatgtcattagaagaagacatatttaatgttttaattgaaatataataaaaaatgatatgaaaaatacttaatatttttcatatcatttttttatttagttttacttttaagatttttatcaactttttctagataattatgttcatttacaatgccttcttcaaaagattctacagcgtgttttgtaaaatttccgatagatgctagatgcgatgaattaatatttttactcataaaaaacaccttcctttaataatagtattccaaatgataaaaaatctattatccatatatatggattaaattgacaataatgtgttataagtgtagaattaagatagtttatggggcaaaattccttaaattataaatatatgaaggagagatttaaatgaaggcgatactaacagtaataggcaaagataaagtagggattatagctggggttagcactgaattacaaaagctaaatataaatatattagatgttaaccaaacaatcatgggtgagttttttactatgataatgatgctagatttaaaattaagcagcaataattttgaagaaattaagacggctttagagttaaaaggtaaagagcttggtgttgaagtaaaaatacaaagagaagaaatatttaactcaatgtacacagtataaaataaagtctttaatggaggaaaattatgaatgcaaataatatattagaaacaattaaaatgattgaagaagaaaaattagatataagaacgataacaatgggaatttctcttttagattgtatagatagtgatggagataaggcaagagaaaaaatatataataaaattactacatgcgctaaagatttggttaaggtaggaaatgaaatagcaaatgaatttggtgtacctatagttaataaaagggtttctgttacaccaatttctataatagcaggtgcaactgacgaaaaagattatgtaaaatttgcagaaacattagataaagctgctcatgaattaggaattgattttatagggggattttcggcattagtacataaaggctatactaaaggtgatagaattttaatcaattcaattccagaagctttagcaaaaacaagtaaagtatgtgcatctgtaaatgtaggatcaacaagatgcggtattaatatggatgcagtgaaagaaatgggacaagttattaaaaaaactgctgatttgactgcagataagaagggatttggatgtgcaaagcttgtagtatttgcaaatgcagtagaagataatccttttatggcaggtgcttttcatggtgtaggagaagctgatagagttattaatgtaggagtaagtggaccaggagtggttcaaagagctattgagaaagtaaagggagaaagttttgatgtagttgctgaaactattaagaagacggcttttaaaataacaagaattggacaattagttgctcacgaagcttcaaaaaggttagatacaccatttgggatagtggatttatcattagcaccaacacctgcaattggagattctgttgcgcatatattagaagcaatgggattagaagtagtaggaacacatggaactacggcagcacttgcattattaaatgatcaggttaaaaagggtggagtaatggcatgtagtcatgtaggaggattaagtggtgcttttattccagtatcagaagatgcaggaatgatagatgctgttttaaatggatcattgaacttggaaaagcttgaagctatgactgcaatatgttcagttggcttagatatgattgcagttcctggagatacatctgcagagacgttatcagctatgattgcagatgaaagtgcaataggagttattaataacaaaactacagctgttagaataattccagctccaggatgtgaagtaggagatatggttgagtttggtggattattaggcagggcaccagttatgcaagtaaataaatattcttcatttgattttattcaaagaggtggtagaatacccgcaccaatacattcatttaagaattagttttttatattaaatagagatatcatatatgagatattaactataaaattaatatctcatatatgatatctctatttttatgttataataagagttttagacagcaattaataatttgtatataataaaatttggaaagttcaaaataaaattgtgtaaaataggcaatactataaataattatcactatacaaattaaagatagtggattattattaaatgttgcataaaatattagaaaaaaatagattggtcgtgaggaaaacaaatgaatgaaaatttagctttagagaaagatattcttgaacaaaagcgtaaagatatattaagagaagtagaacaaaagaaaaaatatcaagaagaaatagaacaaaagttaagggcagtgactaaagaagctaaaggaagttatagtcaagaaaaagaaaatacagaaaaaatatataatcttttaaaaaaggaaatagaaaattatgaagaagcaataaaaaacccttactttggtagagttgattttgatgaaaagtttggaaatcaagagaaaatatatatagggaaaaaaggaataacatctacctatgatggtgaagaaatagtcgtagattggcgagcacctatagcagatctttattatagtggtaccggtggagaggcatattatagagcaccaatgggcgttattgaaggagatttgaatttaaaaagaaagtttttatataaagatcaaaatctcgatagggtttttgatgaagctactaatgagatcattataaatagtgaagaaggttcagggcttgttgatgaatttttaaagattaatttagaagaaagccgtggtaaaaagctgaaagaagtcgtggcaactattcaaaaagagcaaaatgatataattagatggcctaagaacttacccataatagttcagggatcagcgggatctggtaagactacagttgccttacatagattggcttacttgttatataggtatagagaatctatggatgggaaggatattttagttttagcacctaataaattatttttagattatatttcagatattcttccaacattaggatcaagtgatgttaagcaaacaaccttccaagagctagttatgaaacaattaaagttaagaggaaaaattaaaactaaagatgataaattaaaggatcttattgaaattgaggatataaaagaaaaacaatttataattgattcatcaagagtaaagggaaatttaacatttaaaacaataatagatagatacatagctctattagaagggagctcattagagattgaggacatattaatttcaggttatgtcttattctcaaagagagaaataatgagactttatttaaaggatctttcaaattatcctataaataaaagaaaagatgaaataaaaagatatctaagcttaaaattaaaagaaagaataactagtcttcttattcaaattgatagagagtgggatttgaaaatcagagaaataaaaaagataatgaatgatagtgaggaaagaagacataaattaatagaagtatataatgaaagagatagtttaaaggaatatgttaatcatgattctaaaaaggtaatgaatgattattttaagcattggagagggataacttgtagtgatatttattacaagttatttgaagatgatcaaatatttgaaatagctactgcaaatagaattcctgtagaattagcagaatacatcaaaaaagatattcttagaaatcgtgaaaatgggataatagatgaagatgacttaccagcattgttttatattcatatgatgctagaagggatagatgagaaaaataaatttaagcatattgttgttgatgaagcacaagactatagtcctcttcaaatatatttaattaataatatgtctaaaggaaattcattaactttagttggtgatttagctcaagggatatatcattataaaggaattaggcgctgggaagatattattgaaggcgtattcgatgggaaagcaacttttatttctttaagtcaaagttatcgttctactgttgaaataatagaatttgctaattcagctttaaaagcacaagaattaaatataaagagtgcaaaaccagtattaaggcatggtgataagcctcaaattataaaatcagtatcaagaagagaatctgtaaaattaattgatgaaatagtaaagagattaaattcacaaggaaaacatagtattgcagttataactaaaacttataatgaggctaagattttagataaggaattaaagaaatatactgatttagaatatactttaataaagggaaatgaaaaagaggcagcagatacagatatagtaattatccctacttatttaacaaaggggttggaatttgatggtactattatctataatccaacagaaaagaattatccagacaatacattaaatcaaagattattatatgtagctttgactagagctcttcataacgaatatataattgcagaagaggaattatcaaagaatatatttatgggttagtttaaagaattagaacaataagatatatagtgaaaatatttatcttattgttcttctagaatatataaatataaagattaataagtataaaaatctctacatgaagaaattaattccttcatgtagagatttttttatcctgttgtatagatatcgtaagttttctatgtgaattagcagttcctatatggtggattaaaatcatcatatgggaatgaaagttgattaaatgttgcacaaggatcattaacgattgatggttgacatttaggtatttcaccagtatcacttgtaacaactgtcatatttgtaatcctatataattcaatgattgtaaataaacctattattatatcagcacgaccacataccataggtgcatgatctgttgcaacaggatatctacaaatagtagttgataatgagtttgcaattgcttgtacataaacttctggtaaattatgagcatttgattgtgaatgttcaccattcatagagtcaaatgttattactgtagtattatcgtctacacaaccaccttctaatgaaatctttttagtataagttgtataagctggaatagtattatcaggtaagccaggagctccaccaactactgttacaggtagaacgctacctgaatgatctaataactgtaagttgtaagtgaaagtataagtgattacaacatcataaaatccagggatattaaattgtccttgaggatttacttttgcagtaatactagttgcaaagttgcttaaatgaaggctttttactgtatcatcaaaaataatagtatttccattagtaattgtaccaataattgggcttccgttagggcttgataaacttgttgcatgtagcatacttgaaggtataggaatgatttgacaagcatctggcattactggtcctggactgtcagatgactcagaacaatcaatgctacatggcattgaaggtggcatcatagggccgcatattggttttaaacagtcttgttgtttacatcttccatatatttttttagaaattaaacattcatcatagagtgtatcagattgaacaacattaaaattgtcttgtgacatatagatatcctccttaaattctggattacgattaatctaataactataatatgaggggaataataaattgtgaaaagtatttttatactcgaaatatcaataaatttaatacatattcataaaaataaatacatatttttattatagaataatttaaggtgatattatggttaagaaaataaaacttattgattatgaaaaagagatttataaagtttttatagatcaaaacaatttatattgttcagtatcaaataaaatattagaactaggcaaggaagtagaagattattgcttagaatattttaataattccatatggatagcattttatgataaagtatatagaatttcagtgatagaagtatgtttagaagtaaatgatgaaatgaagccaataaaacatttttctatggaagtaaataagtactgtaatagtattgatttattaacaattatcattaaaaatgaagagcaaattaatttaatttttaggggatggaataaaactaaaactaaagcattaatttataataataaaataacaaagctaaatagcttaagaataatatctgatggaacttcaagtggaagtagtagaccgtatatagttttttattcaaatgaagataaggctaatatattactttgtgaagaaaatcaatataatgaatatgttatttatgatttattaaatgaaaacattacgacaagctttgaattgactaatgcaaaaaatatttcattaataacatatgaagaacagactatattgttttatagcaaaaaaataagtggtaatatggaaatgaaatttagacagataaatttagataaagttgatgatgtattaaaagatgaaaagagtttagattttcctaaaaatataaggaatccaaagatatcaacatttatggataatgtatatgttatttggaaagatgaaaatggaattaatactgcaaaatcaacaaacttaaaagagtggagtttaaacttatataaaaacaagccaattagtgcttcaattataaaggtaataaataataaggcagaaaaaataaatacctattttaatgcaagaattattacagattatatttataacgaaaataatcataatattcaaaaggaaaataagctaataaacttaaatagtgaaaatataattgaaaataaagttaattatataaataaaattagtgagttaactagaaagtataataagagatataatgaatatttaaaaaaaattaatgaattaaatagagtaattgatgaaaaagataagttaatctttgaattattaaataaaagataataagtattaaatatttttaataaagcatagcttataatagaaatattatgggggaataaaatgaaagtatatgatttggagaagttttgtattgaacaagaggataaaataaaatgtttctatacaaatgatagagaggtatttatttctgaatataaggagcatcaattaattaatgaaaaatcattaataaatgattgtaaaattttaaataatgtgattttaaatttagataatagtataacaatcctttatattaacttaaagggagaattaattttatctaaattaattaatgatgagcttcaagggtcagtattattgactaaggcaatatctaaatataaatcaattcaaatagcatcactagataatatgttgaatatattttatatcaaagaggtaaacaatataagtgtattatgttttagaagattaaataataaattattactatcatgtgatatttgtatggatgttttagatattaatccagaaataccatatattttaaatattgaagataataaattattagtagcatatataaaattaggaagacctaattgcattggttatagaatatttgatgcaaaaagaaataattggtctgattttatagtattagatgcatatccaaatttaatagaagatattaattttataaaaaataataagtatatagcatatacttatacttttaaaaatggtaataatagaaatttattatttggagttggagaaaaagaaataagaaaaagaattgtagatgaaataactaaaaatgtgaaatatgcagatatatctataattaatgatgataggcttaatatagtaactatagatgaaaaaagtgctaagataagacaagttgatagtaaaggtgaagtaaaatccagtttagaaataaatttacatggtataaagagtatagaaaaatattattttgaaactaataagaaaactttaaagaatacaataattattattaaaacaatggatggagaattatatactgatatagatttgattgaaaataatgcagaaaaaattaagttgaaaaaaaatgttgaattagatcaagaagaattagactctatagaaagcaaggctatagaaagtgcagtaataatgacagaagaagagttaaaaaatgaaatgaaagaaaaaacaatagataaagagtatgttgataagcttatggggaaaataacaggttatgaagagataataaataagtttatggataggtttacgcaatttgatgatgatagagaagagcttttaaataatatagatgatttaaatgatcaattagaagagaagaatactaaaataagcgaatttgaatcattattaattgaaagacaagacttgctatatacatatgaaactaaaattcaaggattagaaagggaaaaagacatagttaatgtagcaattgaaggtaaaataaatgaaatagaaagcttgaatcaaagtataagcaagtataagaatgaaaataaatattataattatacgatacaaaaattagaaagagacatgcaaactgataaaaaactaatagaaaaaaacttagaaaaaattggacttttaatggaatctataagaaattacgaaaatgaacataaagattactataatagaatacaggagttagaaaataataagaaaattgataaagaatctatagataaaaacttagaagaaatagagatattaaaagaatctataaataaatatgaaagtaatctttgcaattataataacaaaataaatgaattaaataataaaatagaagagttaaacaacacaatatcagaaaatgaagaagaaataaatagagtaaatgaaattaataaagaattaaaggagaaaaatagtcaagaggttagcaaattaaataagcttcttaataaaataaaaatagaaaataaagaatatgttgatgaaattgatgaattaaagctcaaattaaatgagttaaatgatattattcaaaatggaaaagaagaaaaaacattatatataaatgaaataaaagtgctaaataacaaagtgagagaactaaatagaatccttagaaatggatttatgtagttggtaatgtaatatatataaggggagtgtatttcctcttattttattatgcaaaaaaatattactggaaatcaaaatttccagtaatatttactttataagaaactatattacacaaaatttttaagtatattgctagaaataataagagtttaattatttattatataagtttctaattgcaataataaaactttctatatcattaaagctattaaaatatcctggactaactctaacagttccaataccttctgttccaataatcttatggataagaggagcacaatgatagctagtgcgtaaataaatgtttagtgagtttaaatattggccaatttcagagctatcatggttatcaatattaaatgataatacaggagtttttaataagggatttgtttcgccatagagtttcacgaaggataatttttgtaattcattcgttaaatattccataagggcaatttcgtgttgtctaatattattaaggcctttagataaaataaactttacaccttcatttaaacctattattccgggagtgtttaaagtaccgctttcaaatttatctggtaaaaagttaggttgaatgaatgagtcagaattactgccggtaccaccttcttttaaagaaggaatatcgatgttatcagaaatgtataaaccacctgttccttgtaaaccaaatagtgatttatgaccaggaaaagctaataaatctatattcattttttttacatctatatcaatatagccaattgtttgagctgcatcaactattaagaaaatacctaatgatttagctaaatttccaatattctcgatattttgaactgtccctaaaacattagagccatgattgattataatagcttttgtattttttttgacagctttttttatatcatttatatctaaatatcctagtggatttacagggataatacttgtttcgatattgttttttcttaaggaatataaaggacgtagtactgaattatgctcaatcattgttgttatagcatgatccccaggctttaatatacctttaatagctaaatttaaagactcagtagtatttgaggtaaatactatgtttagaggattttctatatttaataatttagaaagcctttctctacaatcaaatattttgacctcgcattgaattgataaattatgagatcctctgccaggattggcacaataattccgtaagcaatcatctacagaattatatacttctactggctttggaaaggttgttgcagcattatctaaatatatcataaatcctcctaaaatatattattggtaattaaatgttaattttttcgtaaacatatcgtttggtttttgtattgacatattttttatgaattgcacgtatatgtgcatttttatcttttataatttctataaccttatctatcttatcttcagatacctcaatagaacgtgcacagcctgctgaaaggcaacaaggggtttgaatcatataaattttcagggattgttcttttagtaacttatataaatacatactatagtttgcagagtcaaaggttattatatatactggtttttcaatcattttatctccccctagtttgatttcttattatagtatattcatagaatataaattgagtgtaataaaggataaaataaaagcatggtgcaagaaaagggttaatatataactcttaaagaggaaggaaaaagcttttaaaaaagaattgtattccattaaataagataatataatataatattcatatggagggatgaaaatgaaagtacaaggaagtttaaagcaatatttaaaatggctaataggaagttatatagtaattggaatattattgctatttaatagtaaattaatttttgatttttcattaagttgtgcagtattaataataccttttgtattatgtacaattggatatggtgtaatgtcactaaatagaaaatacataactagcggtattatagtagggattctatatgttatagcaatggtagtatttagtccaattataatgccaagtgctcatagaaatttaattggagatgttgaagaaatcgagtttacaagcaagatagaacatatggatttaaatcaattaccaattatagataagcagttagcttacaagcttgcagataaaaagttaggggaaatacctagtttgggaagtcaagttacaataggggatttatcactacaaagtgttaatggtgaactttattatgttgggccattagagcattcatcattttttaaatggttaactaatcatgagggaactaaaggatatataaaagttagtgctacaaatcaaaatgatgtacaattaataactgagttgaatggagaagaaatacatttaaaatatattccatcagcatatttgtttagtgatttagatagacatgcttatttaaaagatatgacagcaggtcatactgattatacttttgagcttgatgatgaaggaagaccttactgggtaataacaaggtatgataatgctgtaggattaacagagcaaaaagctataggaacagaaataatagatgctcaaacaggtgaaactaatatttatgacattgaaaatacaccaagctgggtagatagaatacagcctacgagttatataaataattatttaaataaatggggagagttggttcatggaatatttaactttagtgataaagataaattgaaaactactccagatatgaatattatatttaatgatgatacttgttactattatacggggattacttcggtaggtaatgatgaagggttagttggatttatgttaactaatactagaactggtgaaactacaatgtacaagactgctggggccacagaaagtgctagtatgaagtcagcagaagggaaagtacaacaatatggttatacagctacatttccatatttaattaatatacaatctgaaccaacatatttcatgactctaaaagattcaaatggactagttaaacaatatgctatggtaaatgtaaagaattataatacagtggctgttggagatacattgcaagcaactttaaacagatatttagaagcattaactaatacaaatatttcattagaaggaagcaatagtgaggaagctttaacaggagaagttgaaagaatcggattagttgttaaagaaggatcaagtatttatgatattaaattaaagggacaagataatttctttacagtatctactgaaacatcaagagaagttgcattaacacaggttggagatgttgtagctcttaaatttatccaagttggagatggacaatatattattactaattcttttgagaatttatctttaagaggtaagatagataataatagtgaaccatctttagaagaagcaggtaaagcaaatgataataatgatttaaatgtacaagaggataatactgaagcagcaactgatatacaataaagaaaatataaattttaaggaactaccaagtttatacttgatagttcctttgctttaaaattgataaaaagttaaataaaatttttgctgtaagtccccaaataacataatcattataagtataaaataaaacctcataggaaccagttttaaatttataattttgtttactggggattaaatcataagggaaattatcatgaggtgctatattaactttattaaggtatttagtaggctcatgatttaataagtactgtaaaggaactaaaaaaaccttttctacttcactaaaattaatggataaattgcttagattatttattgttattaaatatggatgaattagtatatcaaagggagaaataaataaatctaaaggggatataatacttatatcgttttcgcagataccaatctcttcacatgtttctcttattgcagcatccaatggatgttcatctttttctattttaccaccaggaaagcaaatttcacttggttgacttcgaagagttttagctctaatctcaaacaagatatgtggttcgtcattataattaacaattggaattgtaattgaagcacgtttgaaattttcccaaccattaatataaggcttgtaatttgaaaaaatgttgtttatagtattactcataaaaatcacctaattatttttattaaaaaaatatatattatattcaaataaaattataatttaattactaaaatgaaattatactaaaaaatagtatgttatgtctaggagtaataaatgtataaaatatggacaatagatgatataaaattagttgttgataaaatagctaatagatggaattatccatgcaatataaaaattgaaatatcaaaaagagctacaaaaagaatgggagcatttttttataaacgcaatgggaaaaatattatcccaattaaatttgtttttgcttatacattaataaatggtacttattcagaacaagtagttagggaagtaataattcatgaatatttacattattactgtgatttaagtacaaataaaagtaatgggcacaataagttttttaaggagtgctgtatagcgagtggtatctcagatagtactacatttaaatattttaatgaagaaaataataatgatacaaaatataaatataagatatattgtagcaagtgcaaaaaaatggtttgtgtacatgcaaggaaagatgctgcaaagagaaaggttaactcttatatatctaagtgttgtaatggtaggctttactgtgataatcttatgtagtatattaaaagagttataaaatagaatagcttataaataaaggagaataaataaatgagtgaagatataaagaaaaacgaaaatgaagaagttaaaataatgacttttttagatgaaaatgggaataaggttgagtttgaagcaattgcaagaatttttttaggtgaacaagaatatttactattagcaccagtagaagagaaagatagtgaagatatttacgtatttagaattgatgaagtagatggtaagcaagagctaaatttagttgaagatgataaagaatttatagctgttaaaaaagaatataataagttattatactagtgttataaggagaaataactgtgcaagaattagaaattattaagattttaaaagaaaatgatttatcagatatagaagtattaaaaaatacagaagaatatgttttagtaaatttctattttgattttgataaagatttacaagatgcagccaaagcatatgcaaatgaagaaagtaaggaagaagaatttagttctaaatggtatagcgaatactacttcccatatctttacgactttgctaatgacgaggttttagaaataattgaggaaataatagaatcacttgatattgaaggcgaaatgatggccttccaaatgactgaaaaaacaagtgattatgttcagtttatggcgttatttacagaagaagaaagtaatatagctattgaagaagttgtaagagaatacttgtctaaataaaatgaaaaataggttaatatttacattgcattttgagtaaaatttgatataattaaatcatgaaatcctgagatgtgcgtttagcttatgatgttcaacctacattatatttacgggatttgcaacatatttgtggatgtcgggcttccgatttagtagaagatggctgaagcaagttgagcagaacccacctgcgagctgcaggtgtgaatatttaagccaccggcatgttgggagatagttttaaaataaacacctcatttatgaggtgtttttttgtttatgcagcttttgaagttttgacaacatatttttttgaatgtttccttttataagttctatatataaggtgttgatatctccatacatgcctgtccaatacttgagatatgtatacaataaaagagtttgatggggataaaaatttcaaaagaaaatttaaagttattttctctataataattgtctgttttagctgttttttattcataaaagccctctattatatttttttaacagtgtataaattgttataatatattgaagcggaaagtaaattgtttaaaatatacaaaaagtgattgcatatacttctatgtatcttaattttaaaattgtaaagactaaattgtgtaattaaaaaagatatatgtaattaatttggcgaaaaacagttaaaattcaaatattaaatctttgagttgatattaaaaagaaataaatgtaaaataagtattagaaagattctaaaatgcttataaaagaagggaagttaaaaaatggattatacaaaagcaaaaatggacgacgtagtagttagaattaatgagttatataagaagagtaaagaagaaggtttgactgaattagaaaaagaagaacaacaaattctaagaagaagatatatagatagctataaggcaaatcttagagctcaattagagggtgttgaacttaagaataagaaaaaatagagggtgattaatattgtcagttactgtagagaaattaatatcagattttgatttagaagttttagttgagggcgaaaaggatgtaaaaatatctgttaacgatataaatagacctggtttacagttagctggtttttataattactttgcaccggaaagaatccaggttattggtaaagctgaatggagctttttagatgatatgggaattgaactaatgagaaaaagagttaataaatattttagtttcaattcaaaatgtgtcattatgactagagacttagagccacatagtgaattcttaaaagcagccaaaaaaagtaaaacatggcttttaaggacaaacgttgttacaacaaagtttataagtaaattaactatgtatctagcaggaaagcttgcgccagaaacaagattgcatggtgttttagttgatgtatatggtataggtattttaattactggagaaagtggaattggaaagagtgaaactgcacttgaattaattaaaagaggacatagattagtatcagacgatgcagttgatataaaggaaatagatgggagtttaatcggtacatctcccaaaataacaataggtatgttagaggttagaggaatagggataatagatatttcatcattatatggattaagttctattttgccttcaaaggatataaatcttttaatgcattttgagcattggaaagatgatggtgactatgatagattaggaatcgataaagaaacacaagaaatattaggagtaaaggttagaaggttaagagtacctgtaagaccaggaagaaatattgctgttattattgaagcagcagcaggtaattataggcattccttaatgtcagatgttactccagtagatattatagaacaaagaatgtgtgaaattaacgaggaagaataaggagggctagttgtatgagtaaagaaataaaaaataatgcatggttaaagtatgatagtacagaaagaaaggaaatttttgatttctgtgaaggttataaaaattatttatcagttggaaaaactgaaagagaatgtatacatgaagctattagacttgctgaagaaaaaggatataagaatttagctgatataattaaaaacaatgaagaaataaaggctggggataaagtttatgctaataataaggataaaactttagctttatacttaattggaaatgatagtatagaaaatgggatgagaataataggatctcacgtagattctccaagaattgatttaaagcaaaatccattatatgaggatggaaatttagcattaatggatactcattactatggtggagttaagaaatatcaatgggttacactaccactagcattacacggtgttgtagtaaaaaaagatggaacaaaaataaatgtagttgttggagaagatgatagtgatccagtattagggatttcagatcttttagttcacttatcaggagaacaactacaaaagaaagcaaatgaagtaattgcaggtgaagatttaaatgttttagttggaaatattccattagaaggaaaagaaaaagatgctgtaaaggaaaatattttagctcttttaaaagataaatatgattttgaagaagaagattttatttctgctgaatttgaagttgtacctgctggaaaagctagagatttaggattagacaagagtatggtaatgggatatgggcaagatgatagaatttgtgcatatacatctttaatggcattattagaagttgattctgtagaaaaaacatctgtaattttattagtagataaagaagaagttggaagtattggtgcaacaggaatgcaatctagattctttgaaaattctgtagcagaagttatggatagaatgggacaatataatgaattaaagcttaagagagcacttcaaaattccttaatgttatcagcagatgttacagctgcatatgatcctaactatccagcagcatgcgaaaagaagaatactgcttattttgcaaagggattagtatttagtaaatatactggtgcaagaggtaagagcggttgtaatgatgcaaatcctgaatttattgcatggttaagaaaaataatggataaaaataatgtatcttatcaaacagctgaacttggtaaagttgatcaaggcggtggaggtacaattgcctatattttagcgcaatataatatggaagtaatagattgtggtgtggcattacaaaatatgcatgcaccatgggaagtttcgagtaaagtagatatttttgaaactaagaatggatataaagcatttttagtggagaaataattaaaaggtgtcgatataatcggcaccttttttatgcaataattatttataacattatagagtatatacagtttaaaaatatattatatttatgagggaatttgaaagtaataatattacagtatatataggttaatggggtatgaaggttttgttttaagcaaattcttcatacctcagttaagttttaaggttaaatgctatttgatatacaatattgtcaatccatacaagtaattattgtgaattaattataattaagtttatcaaggaatttttttaaacgttcttcttcaatagacatagaacctaatatgccatgttttttatcatcttcttcataaccatgggaatctgaaccacaagaagttatgatgtttttttgatctactatctttaagaagtttttagtatcttcaggcgtattaagtccgtaaataccttcaataccatcaaagtctaaataaagaacatctaaaacgtgaagcttttttaataaaacaggatgagctaacactacaagagcattatagtttcttaatagcttaataccttcttctgcatctaatttgtttgctggtacataagcaggacaatgatcgcctatgaaattatcgaaaatgtattcttttgtgtaattatagcctgcatccatgattgctttagctatatgtggtctggcaatagtatcttttccattttttaaaacatcattaacatctatttcaatattattaaacttttttagccttcttacaatttcatgtgcacgtgcaattcttttagtttttaaatcttctaagaaatgatttaagtctggatttttataatcatcacctttaaagtatcctaatatatgtactgtttcgcctttatatgtagtagataactctactccaggaatgaagttgatatctaatttttcagcttcagcgttagcttcttcgattccagatactgtgtcgtgatctgttaatgctaagtatttaacccctcgttcaaaggcttttttaacaacctcactaggtgaatatctcccatcagaagcagtagaatgtgtatgtaaatcgcatttaatcataataaaattaagactcctttcaagtaaatgttttgtagtatataaagctatgatataatttattcattaataatgcaataattaaggagtatattagttacaaattaaactttaaagaaaaataaactattattaatttatggatttataagaaaaatatatataataagtattagattaaaaacagtaggagaaaagtatgttattaatgatagataattatgattcatttgtgtataacttagttagatattttgaagaattaggtgaagaaatagaagtggttagaaatgataaaattaaaattgaagatataaaaaggatgaatattgaaggaatagtaatttcaccaggtcctaaatctccaaatgaagctggattaagtttagaaataatagataattttaaaggtaaattgcctatattaggtatatgtttaggacatcaatgtatagggaaatactttaatgcaactattaaaaaaggaaaagagcctgttcatggtaaaatattttacataaatcataatgaagaggatttatttacaaatgtgaaaaatccattaagagttacaagatatcattccttaatagttgataaagtagatttgccagaatgtttagaaattacaagtgaaactgaagatgaagttataatgggaataaaacataaagattatgatatttatggagttcaatttcatccagaagcagaaatgacagaagaaggacacaagatactgcaaaattttataaatataactaaaaaatataaagagaaaaatatgaataaaaaaatgcagttaggggagtgttaagtatgttgaaaataatggaatttggtagtgaactaaatgcttttgaagtttatagcttttttgaaaaatataaaaattcaatattattagatagttcaaaagaggataaaaatttatcaaaatattcatttatagggttaaatgaatttatggttttcgaagcgataaattcaaaatcatatattgatggacaggaagttcaaggggaaccatttgaagttttagaaagattagtagatcaatacaagtacgatatacataatgagattccatttttagctggaacaattggatacatttcttatgattcaggaagaatgttagaaaatttaccagatacgtctcaagaagattttgttattcctgatattagatttgttttttataagaatttaatagtatttgatttagaaaataataaaaaatacataacagacatagatggagataatgaaagaatagataaaatattaagagtaataaatgatggtaacaaaatgaaagagaaaattgtagttacagaaagtgttaatacattttactctaatttcataaaagaggactataaaaaagcgatttcaaaattaaaagattatataaaatctggtgatgtatatatagcaaatatgactcaaagattttggtgtgaaaataatgaagaggctttttctatttataaaaagcttagaagtataaataaagcaccattttcagcattcttaaattttaaagattttcaaataataagttcatctcccgagagatttatacaagtaaaggataataaggcccatacgagaccgataaagggtacaagacctaggggaaattctttagatgaggatgaaaaaaataaattagaacttataaatagtgaaaaagataaagcagaattacttatggttgttgatttagaacgaaatgattttagtaaggtatgtaaaccacatagtgttaaggtaacagaaaactttaagcttgaagaatacgcaactgtatttcatcttgtatcaactgtagaaggtgaattaaaggataacgtgtctgcagtaagatgtattaaggaatgttttccaggtgggtcaattacaggtacacctaaaataagagcaatggaaataatagaagagcttgaggggttaaagagaaatatttatacaggtgccataggatattttgattttagaggtaattgtgattttaatatagttattagatcaatattaaaaaagggaaataaagcttattttggtgttggtggaggaattacttatgattctatagaagaagatgagtataatgaaacattagataaagcaaaagcattaatgagagtattataaaaggtagtttgatatgagaaaaataatatatggaaatgaaagtataagaattgataatggattattttttggtaaaggtgtatttgaaacaatattagtgaaagaagaacctatttttttagaagaacatattaagagattaaatgattcgattaatgaacttaatattggtgaagaaattgaatttgattatgttagtaattttataagaagtaagaatataaaaaataaagcactaaaaatagtagttacagaggaaaatttaatattttctgaaagagaaataaaatataaaaaggaacattatgaaaagggctttatagcttgctttacaaatgttttaagaaattctacgtcaagaatagtgaattttaaaactttaaattatttagaaaatattatagaatatgaaatatgccaaaagaatggatttaatgaagctatttttataaatgaaaaaggttatatatgtgaaggatgtacaagcaatatctttataataaaggataaaacaatatatacacctaatattaaaaatggattattgccaggaataattagaaaatggattattgataattttaaagttattgaaaaaaatataacaaaagaagaggtattaaatagtgatgagctgttttttacaaattcattagttggggttataaaatgtacaaagatagaaaataaaaaatttcattgtaaaataacacaagaaattaaagagcaatatgatgaagcaataaatggaggcgtagaatgatgaataaagaaatgataatggaaggtgttaaactaatcttagaaggaattggagaagatgttaatagagaaggattaattgaaacaccagatagaatagctcgtatgtatatggagatatttgatggaattggtaaagatgcaaaagaagtactatctaaaacattcagtgtagaaaataatgatttagtattagagaaggatataacattcttttcaatgtgtgaacatcatttagtacctttcttcggtaaggctcatattgcatatataccaaaaggaaaggttgcaggattatctaagcttgcaagaactgttgaagtttatgcaaaaaaaccacaattacaagaaaagcttactactgaaattgcagatgcaataatggaatatttagatgctgaaggagctatggttgtaattgaagcagaacatacttgtatgactatgagaggtgttaaaaagccaggagcaaagactgtaactactacatatagaggtgtatttagagaaaatatagatttaagaagagaagttatgaatttcataagataggttattatagttaagagttaaatagaggttagttaattttaactagtaattattgacttggtagagaggtatagtaatggagaatatagataagatacttaataataagctatataaagaatctttagaaaagttaaagctttatgaaaaagatagagaattttgtaatcatactatagaacactttatagatgttgctagaattgcttatattatggtgttagaagaaaagatagagatttctaaggaagttatttatgctataggattattgcatgatataggaagagtaaagcaatatgaagatggaacaaatcatgatttagcaagtgttgaaatgagtaaagaaatactaagcgaaactaaatttgataaagaagaagttaatattattattaatggaatagcaaatcatagaattaaaagcaataataagctagaagaaataatttataaagcagataaattatcgagacaatgttttaattgtaaagctgagaaagattgttactggagtaaagaaaagaaaaactttaaagtatcatattaatgaggaggatacgtatttgagaataggaaataaagaatataaattagatgatagaacatatattatgggaatattaaatgtaacaccagattcattttcagatggtggaaaatttaatgaagtagaagcagcagtaatgcaagcaaagaaattagtacaagatggtgctgatataattgatgttggtggagaatcaacaagaccaggtgcggaatatgtttcagaagaggaagaaataaaaagagtagttcctataattgaagctataaaaaaggaattagatattactatttcaattgatacgtataaagctaaaactgcagaagcagcaattaaggctggtgcagatataattaatgatatttggggagctaaatatgataaaaatattgcaagtgttgcagcaaagtatgatgttcctataatattaatgcacaatagagaaaataagccttatgaaaatttaatggaagatgtaaagaaagacttacaagaaagtattgatattgcattaaatgcaggtgttaaaaaggaaaatataatattagatccaggaataggttttgcaaaaacttatgaagaaaatttaatagtaatgaataattgtgagattgtgaaaaaaatgggatatccagttctattaggcacatcaagaaagtcaatgataggattaactttaaatttgcctgtaaatgaaagagtagaaggtacattagctactacggttattggaataatgaagggtatggattttataagagttcatgatgtattagaaaataagagagtagcagttatgactgataaaataattaaagaaaagtaggtattaatatggataaaatatatttaaaggatatagagatttttgctaatcatggagtttttcaagaagaaaagactcttggacaaaagtttattttatcattagaactatcattagatattaaagaagctgctaaaacatatgatttaactaaatcagtacattatggtgagttatgccataaggttatagaagtttttcaagaagaaagcttagatttaattgaaagtgtagtaaataaagttgctaactttatattagataactattcaatggtaaatggagttaaggttctattaaaaaagccatgggcacctataggaaggcatttagattatgctgcagttgaaataaatagagaaagacattttgcttatatatcaatgggaagtaatatgggaaataaagaagaaaatttaaataatgcagttaaaaagattaaagagattaatggtgttaaggtatcaaaagtttcatcttatatcacaacagagccatggggaaatgaaaatcaagatgagtttttaaatggagcattgaaagtagaaacttatttaacacctaaagagcttatgactgaacttttgagaattgaaagtgaacttggtagagtaagagaagttaagtgggggccaagggtaatagatttagatattatattatttgatgatattgtaagtaatgatgaatttgttattattcctcatccattaatgcatttaagagattttgttttagcaccgttaaatgaaattgcaccatatgcattacatccgttgaaaaataaaagagtatttgaacttttagagaattaaaataaaattgctaccgaaaatatttctataatagatttattttcggtagctttatttaaagagaatttttatgaacttttaattatttgagtttgttttattaataatatatacacaaaaagaatatatattgtttctagctggaacattatccatagttatcatatcttcttgaagattaccatcccaagggaaaagtgttacagtatttttatcatatacatttattacatatttatcattactgttatcatcaaattgaattattaacttatatttcaccatagcgtcatccaaatctaattcatttacatagttatcattatttaaggattctaggaatgcaggtaaaacatctaaatcttcttctgatacatcatgatattcataaaagtttacatcaaaaaccttaagtgaataaccttcattatttttaatctttttatatacttcatttgaataataataaggattaggtttgcttttaaagtttatgtacttagggtcattaaaaacacatccagataaaagagttacaagtaataatataattaataatttaatgtttttcattttatcctcctaaaaataactatataaataattattctataaataatatttttagaacataataatatgtaaatagctttttaaataatattaagtgggaaagtaataatgtgtaaaatttgaaaatagtataatttgtaagcaataaattaggtaggaaagttaatgaaaataattgcaacattaggtccaagcacatctaataaaaaggttattgaagatttaataagttcaggggctgatactttaaggttaaatttttctcatttctatggaaagcaatttctagagatgttatcaatagcacgaaatatagataaagatataaaaataatcgctgatttacaagggaaaaaaattagagttgatgaaaaattaaaagatacatttaaaatatatactaatgaaatagtatatttttgtggaaatgatgcttatgacttatttagtaaggggaatgataaaattaaaattattcctttaaatattaattcagaaatcatagagggtaatgaagttaataaaatttcaatgaaagacggaactatgaattttgaagtgatagataaggatagaggagttataaaagtaagagtaaaagatgatggagtaataagggctggcaagggatgtaatattccaggtatagactataaatataccaaattaagcaaaaaagataaagaaagtttaaattgggcaattaataataatataaaaataatatgtcagtcatttgtagaaagcaaaagagagatagaggatataaagaaatatatacaagaaaataataaggatataaatgaaataaagatattatctaaaattgaaacaagtacaggattagagaattatgaagaaataatagagtgctgtaatgggataattatagctagaggagacttaataccagaatatggaatggtaagttcagttgaagcagaatttgagttattaaagaaattaaaaaagtatagaaaaagtaaggaaataataatagctacacatattttagataatatgaaaaaagatacattacctagaattaatgaattagaaagtatatatacatttataaatagtggagcaacaggatttttattggcaggagaaacatctattgggaggtatccaataaagaccgttaaattattaaatgagttaatgaatttatataaaaaataatctttattaaagaatagacaaataggattaaaatgggtattatagtaatgtaattcatatactgaggaggagatttaatgagtgaacaggagaagaatttgcgttggtacaatttagcaatgatggcttttgtagcagtgtggggatttggtaatgttgtaaataattttgccaatcaaggattaactgttattgtatcatgggtattaataataggattatattttgtaccgtatgcattaatggtaggtgaattaggatcagtttttaaagaaagtaaaggtggagtaagttcatggataagaggaacttttggaacaactctagcttattttgcaggatggacttattgggttgtgcatataccatatttagctcaaaagccacaagctgctttaatagcattaggatggacagtaaaacaagatggtaactttataaaagatatgagtcctatggtagctcagttactaactttagctgtatttttattattcttgtggatagcatcaagaggtattacttctttaaagctaatagggacaattgcaggaacatcagtgtttattatgtcattattatatgttgcattaatgcttgcagcaccagctataagaggtgtacaaccagctactgttgattttagtttcaaaaatattatacctaatttcaatttttcatattttactactctatcgatgttagtatttgcagttggaggagctgaaaaaatatccccatatgttaataatatgaaaaaaccaagtaaggattttccgaagggaatgatagcattagctattatggttgctgtttctgcattacttggatcaatagcaatgtctatgatgtttgatgcaaataatattccagcagacttaaaaatgaatggtcaatattatgcattccaaatgttaggggaatactatggagtaggaaaattatttattgttatttatgcattatctaatttattagcacaaatttcagcactagtattttctatagatgctccacttaaagttttattagcagatggtgataagagatttattccaagagcattaacaaaaactaataagtatggagcacctataaatggttatattatgaccgctgttttagttggaatattaataatagtaccagctttaggtattggagatatgaattcattatttgattggttactacaattaaattctgtagttatgcctatgagatatctttgggtattcttggcatttattggtcttaaaaaagctgcagataaatataagtctgattataagtttgtgaaaaatgataagtttgcaatggcaattggaatatggtgttttgcatttactgcatttgcatgtattatggggatgttcccaagtggagtagaaacctttagtggagaatggtggttccaagtgattttaaatgtggtaacaccttttgtactaataggtttaggatttattttacctgttatagctaaaaagactaataaaaaagagacaaattaattaatttcctttcttaacatttaattaataaattattcacagaatatataaagtattaataaccactttaaaaaatatttaataacttatgttgcaaaatataaaatttaatagtataatgggtacataaatttaaagattattgtgtaaatgaggttgagtttgatgaatacttttaaatcgatattatggacagtattaggaatagttatttttattgctataataaagttttttatattccttttaccttttattattgtaattggaatcgtaggatacatagtatttaaagggaaaagagcttttaataataaaaaaagacaaaatgaatcgtataattattataatgaaaatcaaaataattataaagaaaataatattgatgatagcgataatggtgaagtaattgatgttgactataaggaagtagatgaataggaaaaaagactgctcattttaaagtggaccctatgtcaaggacattaaaaaaaaggggctaagccactaaaagctgatttctgtattttacaggagtcagctgagcaacaggtgcgacaggaccacaaggattaagaggagcaacaggagcaacaggtgcaacaggagcacaaggtatagcaggagcaacaggagcaacaggagcacaaggtgtagcaggagcaacaggtgcgacaggaccacaaggaataagaggagcaacaggagcaacaggagcacaaggtgtagcaggagcaacaggagcaacaggagcaagaggagcaacaggtgcaactggagcaacaggtgcacaaggaatacaaggagagcaaggaatacaaggagtacaaggggaacaaggaccacaaggagaacaaggaccacaaggtgtacaaggtgagcaagggccacaaggtgtacaaggtgtacaaggagaacaaggaccacaaggattaagaggagcaacaggtgcacaaggtgagcaagggccacaaggagaacaaggaccacaaggtgagcaagggccacaaggaccacaaggagtacaaggagaacaaggaccacaaggaataaggggagcaacaggagcaacaggtgcaacaggaccacaaggattaagaggagtaacaggagcaacaggtgcaacaggtgcaacaggagcaacaggagcaacaggagaagctggaaacattgatgattatggggtaatttataggccattccaagatgttcaagaattatcttatgctgaagatgttgtttttagtaatcatgaaattacaggaaataatattaaacatgatgataatactgcagcaataatattattaggaggacatccttattttgtaaaatatacagtatcatattcagctactagctgtggctgcaatggaaatgatataatttttgctcttactgatggtaatggaaatgagataccagcaagtaagcatgtagcatcagtttcaaatcaagtttatgctaataatatttcattaggaattctattagaagttaatgatggtgaaatggcaattgttaagttaactaaccttactcaagatattcctacagttagagttcatgcagcaactgtaacagtttttgcattaaactaataaaagttaattaaaagtaaaaggactactaactatataaaaggttagtagtctttttaaaatttaattaataattatattagttatctgtattagtagtatcataaggtgatgtattagtatcttctaggaaatttgaggtatcttcatctggagttgtatcattatctattgtatcatcaatagtgttatctgattctgtgttttcagaaccaccaataataggagtatcaacaggatccgtagaattatcattatttatatcatttgaatcatcgttaaataaacctgtaaaccaattccatattttttcaaagaaaccttgagtttcttcagcacttggtaatttaattacattttcatcagtcgcatctacaacaacattatcacctaaaagatcatcgttagttgtttctaatatacctaggtctttttcattactattaaataaaccagtaaaccaatctcctaatccaacaaaccattcctttatagactcaataatgcctgttgatactttttcacccatagcatcaagtttttcgttaacaacatccttaacactatttaaggcatctttcatttctttatagtcataatcttgttctgaaactttagccattaagttttctagttgttgttgttgttcaggtgttaatgtaacgttataattattagttatattatttattgtatcggctatttgtacagtatcttgagtattatttttaataatttcagttttaatatcatttataacaccagttgccttatcttgtccaatatcttcacctaaatcaccagttataactagctcttcagaagcaatttccttttttgtttcatcgagaggttcaccagttgcatcttcaaaagctttcattattccagttaaagcaccagtaccacttacaccaccagaaatcggagtcattgcaattacatttgcatcagtaatgccacaagtggtaagagtactagctatcattgaagaagtaacataagttaaatttactgttttaacattaagaccatttccttttgaagtaggttgtacataagcacaagagtaggttcttgtaccaagttgagcttcagtagcaactccttctaagtattttctttcttcttggttattaacttctaatataacaacttcattttcttttacaccgaagtaatctaaaactatttgtttttgttcagcagataggtttgtccctaaagttacaacattagcaccatcagcataaactgtgctaatatttcctaaaatcattattccacatataagtagtgtagaaatcatcttctttaatcccataattatctcctttaaattaaaatattttattgtaaggtaagttaaatacctaaatggaattacgtagttaaagcagtatgtattacctattttaataaattatatctaattaatattttaaaatcaaatgaacactttcttaaaaatttataattatattatggattatataaatagctagaattataaagtatgatataatgagtaaataaacaaaggaaatttagtgaggtgacaaatttggctaaagttatagttgttgggggagggcctgctggaattatggcagctcttagtgcagcaaaaaataatgaagttacattaatagaaagaaataaagaaattggtatgaaattaagacttactggtggaggtcgttgtaatataactaataatagagatatagaagaattttttgataagatagttaataataaaaagtttttatatagtgcattatatacattttctaattattcacttttagaatactttagtaataatgggcttgaatataaagttgaacttgatgaaaaggtatatacaaaaagcgataaggctgatgaagttatagaattactaaaaaatgatttagagaagaataaagtaaaaattagatacaatacaatggtaagtgacttaatagttgaaaatgaagctattaaaggggttgtaacatcttatggtgaaagaatattaggtgataaagtaataataacaacaggaggaaagagttttcctaatacaggttccgatggggcaatgtattcaatattagaaaagcatgggcatacaattacacctatatatgcagctttaattccacttgttataaaagaagagtttgttaaaagcttacaaggggttgcaatgaaggacgtaatagtttctgcaaaacttaaaaagaaaaaaatagaaaagtttggagatatgttatttacacactttggtatttcaggtcctgcggttttaaaactttcttcatatataactaaggccttaagtgaaggtgaagtagaggtatctttagatttcttaaaagataaatctaaagatgaaatttcgcaaataatgagaagtaatcctaataaaactgtattaaataatttaaaaggtattcttccacagaactttttaaaagttatatttgaaatgttaggattaactgaaattaaatcaagtgatttaaagaaggaagatgaaaataaaataattgaatatatgaaggaaatgaagcttactgcaagagaaactttaactataaaagctgctcaagtaacatcaggaggagtaaaagtaaaagaaattaatgcttcaactatggaatctaaggtaattaaaaatctttactttgcaggtgaagttattgatatagatgcagaaacaggtggatataaccttcaaatggctttttcaacaggatatttagccggctcagattattaaaataattattttgatatatagttaataatatatgaatctatcaaacagtagataaatttttaaacttatctactgttttttatattataaatcaaataaatttaacacctaatattactttgtacatttgatatttttttattttatttaataaatcattttcactcataaaatatcatattttcaaaagtatatatccttagttaattcaagatgaagtgaagttacaaaataacttagatagtttattaaagaattatgatttgatttaaaagatcatattttgagattgtagcaaataaaaaattaaagagtattatgatagtaagtagttttttatggggaaaattatgaatcaaaatggaaataatagttttgatgagtttataaaattttttaatgaatatatggcctcttttgattcagaaactactgatgaaaatagcagtagtaacacttcacaagcaagtaatggtagatgtgaaaattgcatgtttggaaatgaaaatgcagaggctacagaagagcaaaggaaggcatgtagtgatgtgccaggtggatttcaagattttaatccacaaatacttaatttgataactgttttgtttggtaatattgcagcacaaaagatgccatttaatgtacaaaatgctttaggtaactggcttcaacttttaggtcaagtaataataacatttaatgctcaacagcaatattttcaaggtggaccaggaagaatatataatccaatttatagaaatgcagctaatccattttgttcaaattctagcgatgagggacaagctaatgtaagttcaagtaaaaagaaaaaaacaaccagcagttcagaaaataaaatgcaatcaagtaatgatataaatgaattaaagaaatccatatcagagttaagcaagcaaatcaaggaattacaaagtgaaattgaagatttaaagaaaaaataagggtgtaaagctaaaaataaatagctattacatctttattttattataaataatttttagtatggaatagttatgtatttataaggagaaagtaatagtggaaatttaattcttttaaacaaaggttgtgagaaaatgcttgattattttgtgaaaaaatataatttaaatattacatcaatgataagaaatggaacagttgcagtaattacaatggctggtgttggagttttatttggtgttaaaaatataatgatagcatttccaattgcattaacctcaacagtaataggaagacagaatttttatgttaagccatttagtagaataggaagaatattattattagacttattaattgttttagtagcatttatatcatcattaaatccatggattggtatatttatagatttaatagcaatatttttaataatatatattatatcatctccttatgatgcaaccttttataaaccatttataatgttatatgtgtttactcaatattctaagatctctatttatgaacttccaaataggttattagcagttgtttttggtgtaatgataataattataggaacgtatattaaaagatctaatgcaaaagttgtttttggaaatagtattaactctgcattaaaaagtttaaagattcaagtagataatattttagaagataattttgattataagctaacaaaggattgttcaaaaataatgatggatttggtttataaagtatatacaacaaggcataaaggatatttaactactaatcttgggactattcagtttaaattatatttaaatatagagtatataaatatatgtttgaagaagatttttcaagaatataaaaacaataatatatcaaaggaacagatgggggatttatggtcattaattgatttaataattaattattcaaaacaagcatgtaagataagcgatatagtatataaaaatgcttttataattgaaaaaaatagaaattcaacaaatttgtataaagaagtattatttgctatttcttccatcatagaatgcattagagatttagaaaaattagataataaggatattaataaaatatataagaattgggaaagaacttatttagataagccaaaagtaatttttaaagaatattttgtaatttcatcaattagatttaaatttgctatgagaatgtcaattacattgtcatttgctatttttatagctgaatttttaggattctataaagtaatttgggctataatcactattatgtctattatgcaaccttattatgaagatactatttcaaagagtagagaaagggtaaaaggaaatattatagctattttaattacaggaatagtaatacatttatttgattctaagagggttgtaatagtaattttaattttatctttatatctattatatggatttaaggaatattataaaatatcattatttgcagctatggcatcaatatgtgtatcatcattaacagtaaatattaataaattattattttatagagttttatacgtaattataggtgtaataattgttttgttagctaataaatttatatttccatataaattgaaagatggaatagagcaactggttaaaaaaatcttgagatatgacgaatatttaatgaattctactcgtgattatttaaataaaactaatggggctaattctataagggatttagtaatacacataaccttattaacacaaaagctatatcttagaaatatgcaatatggagatgaaaagattgaacagtttgttgatttgaataatgagattgtagtaagaattggatataaagcattaattgtttatgggaaaagatataatgaaaatatttttaaatatataagcagtttatatgaggaatttcaggagagaattaaagggttaatataataaaagatatagattagaaatagggggaactaatctatatccttgtgaagggaatgatattaactaacaaataacactaatttctatgtgctattttctttagtatagtccatgaatatgtcaaatttatgacagttatatgaatttaacataatatagaaaatattaattttatatttgtataagttactatgttaaaagcgtataataatataaataaagtatttttttatagttaagaagggagataaatgaaaaatgttgtcttaaaaaaagttagcactagattaataataataattttagtaattatatttagcataataggatttttaaaaataaaaagtaatagcaaaaagtgggtagatgcagatgttactgttaagttaccttttgagatagatatattgagcacaggaaagtcagattttattttgattgaatgtgaagggaaatttattgttatagatacaggattttatgaaaatagtactgtaataaatgattatttaaattataaaggtgttgaagagcttgaatatttgattttaactcataatgataaggaccatataggtggagcaccaagtattttagataattttaagattaaaaatttaattcaagctgattatgagaaagatactgttcaatataagaattatgttgaggcagttgaaagaaataagttgataccagttttattgcataatgaaattactagagatgttaatggtgctaatataactatttaccctgctttaaaagataagtatgaaaaatctaatgattactgtattattgtcggaattgattatggaaagtatagatttttatttgctgcagatgctgaagatgaaagaatgagggagtttattaatgagaataatggtgaatatacttttttaaagatggcgcatcatggaatatataataaagaagtgggagactttttagaatctgtatcacctaaatatgcagttataacttgttctcagtttatgtatccagatagaaaattagtatctttattagaaaaatataaaataaaaactttttatactagtagtggcgatattagtattaagagtgatggtgaaaatatttattttatacaaaagtaatattaaatagtagaggttttcctaaaaaaacaaatggtttcatttgtttttttatgtctaaaattataaatttttgtgagaaaatctaaaaatgtattttgtaaaaaattacaaaaaaacaaataagactactaaatgattgctactgggatatatttgatatatagtaaaaatatataacaaacacttatatagaaaaataaataggggggagaagtttgaaaatgaaaaaaatcaaacgggtaataagtggagcgatagtttttactgttattgcaagtagtcttgtaaccggtgctacaatgagaacaagaagttttaatactacttatctcaacaattatcaacaaaatgaaaacgttttaaaaattgacatggatgaagatggacaagtaacatattctacaacaagtaacattgaaaaaagctctgatacacaggaggaagtgaaattttcatgggataatgcaactgtatattttgttttgactgaccggtttaaaaatggtgatatcagtaatgatcattcatatggacgagggttagatcaaaatggaaatgttcaaaatgggtatgaaaataatcccggagcctttcacggtggagatttaaagggtttaacacaaaaattagatgaaggatattttactgacttgggtgttaatgcaatatggttaactgcaccttatgaacagatacatggatatacttcaggaaatgcagcaggaggaaatggagaaaataatggagaaggatttccttattattcataccatggatattgggcattagattacaccaatatagatgaaaatatgggtaatgaagaggattttaaaaattttgttgatacagctcattcacaaggaattagagttgtcatggatatagttttaaatcatgttggatatacaactatgaaggatgctaatgaatatggattcggtagtatgatagatggatgggaagattattactatggaaatttaagtgatttaagtggaggaacagttgaagcaaatacttggtataacaaagaggattctacatgggcaactaagtggtggggatcagattttttaagggtttcagcaggttatgatggatatccaaaggtaaatgaaggtggtggatatacagattcactttgtggattaccagatataaaaacagagagtacacaagagataggactaccaccaatactagagacaaaatggagagaagaaggtagatatgaagaagaaatgaaagagttggatgaattctttacaaaaagaaatttacctagaactccaagaaattatgtaataaaatggttaacagattatattagagattttggtatcgatggatttagatgtgatacagcaaatcaagttgatatggaatcttggtcagctctaaacgaagaagcagatatagcattcaaagaatacaaatcaaataatccagataaggtattagaccaagaggcagagttttggacaactgcagaatcctggggacatggagtagggaaatcagcattctttacatctggaaatttcagttctattataaatttcacatttaagggagcaacaatttcaaatttaaaagcaaagtataatgaattagcaaaggttaataaggatgatgatttcaatgtactaagttatatttcatctcatgatgactcaatctatgatagaaataagctaattgatggaggaacatcattactattagcaccaggagcagtacaaattttttatggtgatgagacagcaaggccattaggatgggaagatttcttcacaaagggagaatataaagatcaaatgtatcgtacatctatgaattggagtgacttaacagattcaagtagccaagcttcacaaacattaactcattggcaaaaacttggacaattcagaaataatcacttatcagtaggtgcaggtgaaaatatagatatatcagagtctccatatacttttggtagagtttataataaaaatggagatagtgatagagtagtttgtgttgttggagcatcaggaagaatagatgtggatgtttcaaaggtgtttagcaatggaagcaaagtaagagatgcatatacaggagatataacaacagttaaaaatggtaaagtaacatttactgcagatacaaatggggtaatattaatagaaaagggtgataaatcaccagatgttagtattagtgaacaatcaaaaaaatattatacagatactttggagttgaaactttatgttagtaattcagaagtaggaaaatatagtattgatggtgtagaacaaggcacttatacaaatggacaaacaataagtattggtaaggatgtagagtttgatgaatcaacagtggtaacggtttctgcgaagaatttagatggagaatcagaagcaacatatacctatacgaaagtagatgcaactaagttaaaagttaaaattaattatgataatcctaataattgggccaatccatatgtgtatatgtatagggagattgatggtgtaacagaagaagtagcaccatggcctggagtaaagttagaaaaagatagtgatgggtggtatagctatagtcagccactttgggaaaatgccaaagtaatatttagtaatgctggtggaagccaaaacccagcacaaggacaatcaggtttcgatgttaaggatgaaatgtggtattaccaaggtaaatggtatactcagaatccaacaggaccgactataaatagtattaacactgataaaaaatcaccacaacttataaatgaaagtattcaaatttcagcagatgcaagtggtacaggagaacttaaatataaatttgaggttgaaaaggataaagtaaccgaaataataagtgaatattcttctaatagtagtgtcatttggaatccgactgaagtaggaagttacacaataaaagttactgtgaaagattcaaatgaaaagttaagtgataaagaaattaaattcataattgaaaaaggaaagctagttgttaatgaagttactactagtaaggaaactataaaaatcggagaagttgttgaaataagcactacggctacaggagttggaactctcaagtataaagtttctactcatgagattaatgaagggtggaagagtttaacttcagagtattctactgaaaataaaatagagtgggcaccagaaaaagcaggagtatataacatttgggttgatgtcaaggatgatgatggaaataaggaatcaaaaaatataactataaaagttataaattagattaggtgggaggtaaatatgaaatctatttataaaagatattcagcaatagttgtagccggagttgttggagctagtataattagtggaccaattactacttttgcacaagaaaataagataataagcaaatttataacaagattaaatttaaggagtagcgatgagggaaattattcaacaaatgctactggagtaggtcagtataaaaccattaatagcataagtgattggacagaagatatgataattgctcaaggtgtagctaatgatgatgcacgtatatttaggggatcccatgaaggacctgtatatgatacgtatgcactatatggagcctgggatgataataatttatatctaatgtggcaatttgtaaatgttacagatgttgtagatccagctcaaaattacccaatcagtgataatggaaaaccatataatggtgatataccacagatattagcatttagtataggtccaaataaaagtggggatggtactataaagaaaacagattctaaaacaggagtagtaagttatgatgaaaatgtttggggagttagggtaaactatgaaacaaaagtagatacactaatgtatttttcaagtaagccaggggtaggacaaccagcgatatttaaagtagaggatgattcttgctttaattatgatacagctgttggatttaaggaagctggagtatcattcaaatatgataatggatttttaggaaatacaatgttaggaattaaagataatggatgggcaggctatactccggatgatttatatgatagcgcatctaattgggttaatatgttagatgaaggtcatgatacaaagcaagatacaatgtactctatgacaattccgttagagtcattaggaattgatagagattatattcagaacaatggtattggggttatgcatatatcaacgtttggtcaatcaggaatagcttctttaccacatgataaatcaatgctagatgttgcaactgaagagtatggaccagactcatcaacttcagcagaaaaggaagattatgatgttattactgaatctttagctcgtataggtaaaaaagagattagtgaaaataataaaatagatataaccaatataaagaccgataaagagagtggaaatgttggctcagaagttaaaataaccgctgaatctaaaggaggaaaagatgttgtatattcaatgtctgttcatgaaataaaagatggatggagaaaaataagtgatttctcagatagtaatacaacaacatgggtaccgactaaaaagggaaaatataaaatatgggttgatgctaaagattcttctaacaataaagcatcaggacatatggattacacagtaaattaagtaaagtaattcattgtagaaatataatatggagggaagataatgaataatagaaagaagtttaccagtttttttattgctttagtatttgctttaagtttattatttaataattttacaggactaataactatagcaaatgcaacagaaacaacacaatctttagttagtacaatagatgatggtgcgattttgcatgcatggaactggtcatttgatacaataaaatcaaagttacctgaaattaaagaagctggatatacagcagttcaaacatctccaattcaaggtaataaagaagatttaatggctaattcaaagtggtggatattatatcagccaactaattttaaaattggaaatgctcaattaggaactagagaacaatttaaaaatatgtgtgaagaggcggataagtacggtgttgatataatagttgacgtcgttgctaatcatactggtaatagaggtgggggagacgactcttactatccagcaaataatgttgattcgtctataaaagatgattcaactctttggcatgaacataaaggggttagcgattggaataatagatggcaagtaactcatttaggaattggtcttccagatttaaatacatcaagttggaaattgcaagatatggttataagtttcttaaatgatgctattgcttgtggagctgatggatttagatttgatgctgctaagcatatagaattacctgatgatgatggtggaagtgatttttggccaagagttttaaattctttaaataataaagaaaatttgtttatttatggtgaagtattacaaggtggagcagatagaattaatgcatatcacacttatatgagaactacaactgactggtatggtggatcagtaagaagtgcggttggatatcatagtacagctaatgtaaacaatgcaaaaagttatactgtaagtggtagtgcttcaaacttagtaacatgggtagaatcccatgacacttatgcaaatgatggcaaagaaacagttgctttgacaaatgaacaaattaaattaggatgggcaataattgcagggcgttcaggttctactcctttattctttaataggacagcaggtggatacttagctggtaacatgggaagtgctggagatgacatgtggaaagatccaatagtagtagcagctaatgattttagaaataatatggctggtgaaggtgaatatataagaactcaaggtaataacgtatttattacagaaagaggaacaaaggggataatgatagttaatgttggagatgggactagcattaattgtgacacgaaattagctaatgggcaatatattgactcagtatcaggaaatacatttactgtttctaatggaaaattaactggtaatattggaagacgtacaatagcaacaatttatgctactcaagtaggcaatgatcctcaagtaagtagttctatagtatcaggaactaagtttgtaaattcattaaatataacattaagtgaaaagtatactaaaagtgcaacatattctataaatggtggaaatgctgtaatttatactaatggtaagactataacattaggttcagaatcaaaggtaggtgatataattgctttaactttatcaggaataggtgaagatgggaaaaatgtttctaaagaatataaatatgagaaagttgatgtaattgagaatgctacggcaaagattaaattacctagtggatggtcatcagcaaatatatatgtgtatgatgaaagtgtaagcccaacaaaggaagttgcaaaatggccaggagtagcaatgactaatgaaggtaatggagtatatagctacacattaccagacggatggggcgaaaatactcaagtaatatttaacaatggaaataaccaaataccagcagcacaacaaccaggtttattattaaagccaggtgaggtaaagatttatgagaataattcatggaataatgtagtggttccaaatccagaggtatcaagttcaatagctgatggaactcaatttactaattcattaaatataactttaaatgcaaagaatacagtagaagcaacttattcaattgatggagggagagaaactacttatactgacggaaaagctataacaataggtaaagatacagctataggatctacagttaaattaacattaataggtaaaaattcagaaggaaagactacaacgaaaacttacacttataaaaagattgataaaccagttgtaactacagcagttgcaaagattaaattacctagtggatggtcatcagcaaatatatatgtgtatgatgaaagtgtaagcccaacaaaggaaattgcaaaatggccaggagtaccaatgactaatgaaggtaatggagtatatagctacacattaccagacggatggggcgaaaatactcaagtaatatttaacaatggaaataaccaaataccagcagcacaacaaccaggtttattattaaagccaggtgaggtaaagatttatgagaatagttcatggaataatgtagtggttccaaatccagaggtatcaagttcaatagctgatggaactgaatttactaattcattaaatgtaactttaaatacaaaaaatacaatagaagcaacttactcagttaatggaggggatgcaaaaacttatactaatggaacatcaattactttaggagaaactgtagctataggtgatatagttaagttaacattaacaggtaaaaattcagaaggaaaatctacaacagtaacttatagttacaaaaaggttgaagcgcctgttataacaacatcagttgcaaagattaagttaccaagtggctggtcaagtgcaaatatttatgtatatgatgaaagcgtaagcccaacgaaggaaattgcaaaatggccaggagtaccaatgactaatgaaggtaatggagtatatagttacacattaccagatggatggggagaaaatacacaagtaatatttaataatggaaatgttcaaataccagcagcacaacaaccaggattatcattgccaacaggaaagataggaacttatgaaaatggtatgtggactttaatagaggcagttaaaccaataaaaataacttcatttatagcagataaagtgtcaccacaggttgcagatactaccataaagttatcagtaacagcaactggtggaaatggaacattagaatataaatttacttgtagaaatactgaaaccaatgaagaaaaaactataagaggatattctacaaatagtacagctgaatggacaccaattacagctggaacttataaagtatcagtaacagcaaaggattcacaagggaatacaaaagaagagtcctttgagtttacaatagacccaaggaatacagatatagttttaaattctattaatttagataaaacagaggtaaatgtaggcgaagaaatttcaatttcagcagatgcaacaggtggacttggaagtttaagttataaattttactataagaaaggaagtgaatatactacaataaaagattattctagtgaatcatcagtaaaatgggctccagaagaagaaggagagtattatgtttatgtagatgttagagattcagcaggtaatttaaaatatatatcaaaaaaagttacggtaagtaaaaaagctgttgaaattacagatgtgattgtggataaagctacaataaaggtaggagatagtgtaaacgttacaactatagcaacaggagcttctagccttcagtacagagtagctgttcatgactttgaaaatacatggacaacattacatgaatttaaagattccaatgttacaatttggaaaccggaaattgcagataagcatgtaatttgggtagatgttattgatgaagatggtggttatgcttcaaaatcaatagaagttactgttatagaatagcaaaaataaattaagactactgtaatagcttttacggtagtcttagttagctttatttcatggtataatttacatattactttaaatatatattttattttacaaatacaaattctttgtcggtagaaagctcttctgaatatttaaaagatagttcagagaagtttttaacatcctcaatattctctatattattagaagctaaatatcgtaccataagtcctctagccattttagcttctgtagcttttactttaattttatcatcttttaattcaccaaatatacaagtaacaaagatatcatttttgcttaaatatttttctattattttactatattcttttgaggctaaatttaaaataacattactagttttagttacttccttatataagttgttgccccaaaactcataaagatttttattattgtcaattttgagttttgcttgcatttctaatctatatggaacaactccatcaaaaggattaagaactccataaaatccagatagtatttttaaatgtgatttaacataattaaattcatcttcactaaaagaatctggagacatatatttatattgaattccttcataagttagaagggcaggagataagtttttatctaaatccatatttttatatctttcaaaatttaatttagctaagtcatcattacaaactaatagcttttttagttcatcatatgaaaaagattttaattgattatatagtatgttagttttatccataaaaacaggatgatattcaaaaataatatcatcattatttatcttcattttttttgctggtgaaataattatattcattttttcaactcctaaattatctaactaatattaattattatttagtataacatagtatttaaatttattataatgaataaagttaaaaaaatattgtaattatgtttaagtaaaaataaataaatatctaataaaataaaatgttaacagtaaacatgtaaacaattggaaaatgaaaattttaaataagatgttactttgatataattaatatataaataaattaaaaggagaagaaagatatgattaagcatattattttatggaattttcaagaaggtaaggggagtgaagaagataaattaaagattaaaaatggtttagagagcttaaaaaataagattccaggaattgttgaaattgaagttataactaatccgatagcaggaagtaatgcagatataatgttaaatagtacatttgaaagtgttgaagctttaaataattatcaagttcatgaagaacatgttaaggttgccacaattgttaaaggtgttacttgtaatagaatgtgtatggattatgaaatatagtttataaaactttcaggggggaatgaagtggaacaagaatatatagattatattgtgaaacaatattttaaggaagaaaattattatgttaaacaaggaagtagtggaatgaataataccactaaattcttagttataggagataaaaaatatattttaaggatatatgaaagtcatagagataataaaaaggtaaactatgagcatttagttttagaagaacttaataaaagaagtttatcatttaatgttccaaaaccaaaagaaaatcttgaaggtaatactgtaagtatgggaatggatgggaaactagtatctgtagcaaaaatgataaagggaactaatccagaattacataatactaaacaattttatagtttaggcaaagctgttggtgaaataacaaaagtgttaggtagtatagaaattgaatttaagcctatttatgaaccatgttatgagcttgaaaaatcttatcctaaatgcactttaaataaggctatagaattttgtattaatccaccgaatgaatttaatgaggaaaaagataatttaatggaattaagtaaatattttattgaatttaaagacgtaatacctaaattaagaattttaccacatcagattattcatggtgatattaatgcatctaatgtattagaagatgaaaataacaatatttcagcagttttagattttgagttttcagcgaaggatttacaagctatggatttatcaatatgcttgtcagaggcaatttcaagtgaaaatgatgataaagtaaagcttgaaaatatgaggagctttattaatgggtataaagaatatgtaaagctttctcttgaggagataaatgtaataccatcattgattatgctgaggagacttgatgtaatattacacttccttgttaggtataaagaaggtattagcaataattttatgtctgcagaggaaattttaaaagagcaaattataaaagcaacaacactatgtaaatgggttaaagcaaatgaagaaaaaataagacaattattttaagtgagattgaaatattagtttataaagtaatatgggggtaagcatatcaaatagatttatttatataaattaatatggagggaaaaacagagtattttttaggagggttttgagatgaatgaggttataaaaaatattaaagctagaagaagttgtagggaatatattgatacacaaatatcaacagaagatttgaatgaaattttagaatgtgctttatgtgcaccaagtggaatgaatagtcaaggatgttattacacagctattcaaaataacgaagtattacatgaattaaataaagctgttaaagaagtatttagggaaagagaagattcaagaggatttagtgaggattataatttttattataatgcaccaacccttgtaatagttacagctaaaaaggattataaatatttttatactgatggagcagcagggttagagaatatgtttttagctgcaacatcattaggaatgggaacttgctggattaatcaattaggagatacttgtgatgattttagggtgagaaggattcttgatagatgtcatataccatcaaattttgcagtaatagggtgcgcagcaataggctattcagcaagagcaaatgttgcgccaaagagagttcaaggaagaagtttaatagttagataaaataatttttaatattataccaatatatattgaatctattttaatcaataggtgtatagatatatattggtttttatttttataaaaaggttaatgcaaaatgttttctaaaatataaatttgttttataatatgtatattataatgggagaaaggctttatctatataattgataaagctttttatatgtgtgaaaaataagtttatagaaatgttaaatactaataatataattttataaagtggatattttaatagaaaaaataatatacaggagatgaagagatgtttaagataatgacagttttaattcatgtaattaatttagtaacaatatcgtatatgatatttaaagaaaaacgttcagcaaataatatcatagcatggacattgattttatatttagcaccgtttataggttttattatacttatacttattggtagaaaaatgaataaaactaatatgtttggatttaaaaatgcagagctaaaaatatttgaaaattacaaaaatcaaattaaagaaagaggggacttaaaagaggaaggtgtcgataaaaaaaatattgatatgattagggctcttgaagctatggattattctccatatagaaatgacaatgaggtttatatgtattcagatggaaccttatttttcgaagaattattgacaagtataaaaaaagccaaaaaaagtataaatatagaattttatatatttaaaaatgatgagataggaactaagatattaaatatattagaagaaaaagctaaagaaggagtagaagttagattattatatgattcagttggaagtagatctttaaatagaaatgtgcttaaaaaattaactgatgttggaggtaaagttggtgaattctttccttcgtggctaaaactcattaatattaatatgaattttagaaatcacagaaagattgttgtaatagataataagataggattcgttggtggatttaatgttggagacgaatacttaggaaagaacaaaaaatttggatattggagggatactcatataaaatttaaaggcagtgccgttaaggatttaaatttaaggtttttagcagattggagatatgctacaaaagaagaagttacattaaatcatgtattagaagttgaagaagaatatatagaaagacctaatataggaatgcagatagtatcaagtggaccaaatttaagtgataaatatgaaataaagttaacatatttaaaaatgatacaaaaagcaaaaagatatctttatatacaatctccttacttaatcattgataatagtatttcagatagtttaaagttagcagctgcttcaggagttgatgtaagaataatgttgccaggtaaaggtgatcatccttttgtatattgggcaaatttagtttatgcaggtgaattaataaaggaaggggtaaaagtatatcattacgatagaaatgcttttttacatgcaaaaactatagttatagatgatgaaatttgttcaataggaactgctaatatggatacaagaagttttgaattaaactttgaagttatttcagtgatatattcagaaaaaatagcaaaagagcaaaaatatgaatttgaaaaagatatgatgaaatgtgaagagttaaccatagaaatgtataataaaagaagtacatttgttaaggttaaggagtctatttcaagattattatcagatgttctataaaagagataaggtaatgaataaaataagaaaaacaaaattatatccaagatagaataaagattaattttattttaaaatgtatgcaagttaattaagatacttataaataaaaaaataaatgtattattacaaggaattaatataaaatcttaaaagaacttatattaattcctatgtagaatgcatttattttttcgagttctgcagttgtatgatactagaatactcctttaattcatctaaaaatatgctagcggcctttgaaagagttaattcttttggataaataatggaaagtgagcgagtaaagtgattatcaagttttatactagatatttcatttctgttttcatcttcagcaataacatgtttagaaattatagttattcctaaattatttttaacagcttctttaacagctaggttgctacctaataccatcatgcttttagtgagtattttattttctgtaaagaataaatctagatattctcgagttccagatccttcttctcttgtaatccaagatttattttgaagatcttcaatgttaaatttagaatattttaatgaatcattgtaaggtatagctaataccatgttatcgtctaaaaagtactcttgtttaaataaggatgatgaagcagatccttctataaggcctatatctaatttgaatttttttaattcgtcagaaataagagatgtattttctattatgacctcaatatcaacatcaggatatttttttgaaaaaatggctaaaaatttaggtagtatgtactctcctatagttaagctagcaccaatttttaagctgcctttaatagaagaagatagggttttaacatccataaatgttacatctaataaacttattatttctttagcccttttataaagtgtgtatccactttcggtaatagatatatttttttgctttattgatctgtttattaaagtaactccaaacatattttctaaatttttaatatgagcactaacactaggttgggataagtttaaatgttctgctgctttagtaaaatttttataatcaactacagcgataaaagttttaaattcttcaatcattttaaaacactccttatataatttaagtataaagtaataatattattataaactattattatatacaaatcatcaaaaaaaataatgattatcatgattaagatttactttactaatgaataaaagatgggtataataatagtatgagaatttaaataacaaaagataaggagtaataacaatgaagaaaaaaaattttatagagtatattaaaggtatactcccaggatttttagttgcattggcagtagcattagtcggaatgtttattgcaaaatttgtgcctaaattaggtgcaggtactatatctatatttttaggtatgtttgtaggaaatttatttttaaatcaagatgtgttccaaaagggatataaattttcagagactgatatattatcatattctatagttttattaggcgcaacattaagtataggaacgctattagaacttggtataggtgggtttacatttataataatacaaatggcaataactattattggaactatttatataggaaaaaaattagggtttagtgaaaattttagatttttaatggctagtggaaatgctgtatgtggttcatcagcaatagcagcaacagcacctgtaatagatgctgatgataaagataaaggaatttcaataactatagtaaatataacgggtattgttttaatgtttattttaccattaatagcaaaggcgttatttaaagatgaaactttagctacaggggcattaataggtggaactttacaatctgttgggcaagtagcagctagtggagctatggtcggtgagcaagtaaaggatatggctatgatatttaaaatattaagagttgtattacttgttgttgtagtatttgtatttggacatataaaaaataaaagtaatgtagaaatagttgaggaagaaacaacagatattaaaaaaggaaaagttaaaattccttggtatgtaataggattttttgtaacttgtgcattattttctttaaaaataatacctaataatatatctcatatatgtaaagaagtaagtaataatttagaaattattgccttagctgcaattggattaagagtaaatgtaagagatttacttaaacaaggaaaagctgtatctttatatgcattaggagttggaacacttcaaatagtagcagcactagtactaatatcaattttactttaacaatagttaagattgacaagacctaaatataaaagtattattattaaaataattataatatatttttagaggtggaaataatggataatgggcttatacatatatattgtggtgatggcaaaggtaaaacaacagcagcaatgggtttagctataagagcagcaggaagaaaaaagaaagtattcattactcagtttttgaaaagtggtaaaagtggagaattaatatcattagagaaattagatgagtatattacatttttcccaggaaagccagttaataaatttgtttgggacatgaatacagaagaaaagatgcaagctaaaatcgagcatactaaaagatttcaagcaattaaggatataatgaataaagaagaatatgatttattaatattagatgaaatcatggctactataaataatgaatttatagaattaaatgatgtaatagaatttttaaataataagcctaaaacattagaagttgtaatgactggtagaaatcctaatgaagagttgatagcattatctaattatgtaacagaaatgaaatgcattaaacatccttttaaagaaggtattccatcaaggattggaatagagttatagggtctagtcaatttaatttacttaatatataatacactagtgttataaaaacttttatacgcatttaataaaaagataaacaaaaaggagccatatatgagagcagtatatagaaatccaaaagaattagcgacaaaactgaaggatgtagtagatttatatcaagatgatttattatcatatgaaaaactagaagaaacagttgtagctatgataaaggctaatgatgatagaatatataaaaatggattcatgccaactaaattaattgcagcaattggagaagaaagaaagtctatagttgataaaatagcggctgataacaatttataattttatgaaatttaaagttagtatttagaagtataatagtcttactaaatactaactttttttgttggaaataataattaatatatttaatgatgaaaaagcactaattcatttaatgattaatataggattgtagttaatagtagcaataaggaatatgtatctgtaaaagcaaataagcttagagaaaatattgaggactatgattttagtgttgattctaaaaatataagtgttactgtaagtataggaatatataattactctaaaaattataaatgtttcaataataacgtaaaatttgctgatgaagctttatacttagcgaagttatttgggcgcaataaagtggttaattattaatattttaaatgaatattaattaaaagggactgcaaaacagtcccttttatttatcatttgtataaagttatgagttgcaatttaagattagcatccacaaccagtggattcactttcgctttctgcagtagcagcatttatacaagatcctttaaaacagctaacttttaaacatttacggataatttgagtattatctttaaatatctttaacatataagttgtgtttggacataaaggaccaaataaaaattgtccattatcatctgtgaaagtatgagttaatggaattggatattcacacttgccgttaacttgaagtagtttaactactgcatcagctacaggtagtccattttcatcaagtactgtaccaaatatacagcttctacattcccttggtaatttaacaactgcatctatttgttcattacaaccagtcttaaaaatacaatttcctattcttccgctcatgaatttatcctcctaagtttattgtaatatactataatatattcttaggagaaaacaatgtgtacataaaagtaaaagttatttatgtaaacaataattagaagtgtaaattaagaaagttgtaatagaaagtagataagtagaaaataataatattaataagagaagtattattgttaaaatgaaaatattaaataaaaattattatttaataaaaaaatattgtaacaaatgttactgaaataataattagttatttgtataattaagactataatacatctatatatttaaggaggaaaataaatgagttgtggatgcggaaatatgaataaaaaagatgggaaggcagtagttgatttagttagaagtaaagataaagcggacttccctttagcaactcctcatgaaatagaatgtagttgtggaaagacatttacaatgaaaaaattagttgataattgtccttattgtaaaatgacatatggtgttactccttgttcatcaagagataaggaaaatatagcagctgcaggaatagaatattaatttagtagaaatgttaaatcgaaactagtatttagttgcgatttaacatttttttgctaaaaattattttaatgttctaaatgtataaccttcattttttaatagtttaattattcctggtaaagcttctacggtagtagtttttgtcatacagtcatgcattaaaataatagctggatttttatagttaccatctttatctttaatatttttagcaacattttgaataagggtttcaggtgggatattattacttttagcatctccagaatctacattccaatcataaacatttataccttgttcattaagctttgtagttatattttttgtgaaatctttacctctagaattagctacaatggtattatgagatccgccagggaatctaaatattgtacaatcactaccagttgtttctttaatgaatttttgttgtttttcaaaattattaaaaaatgcttcttctgaagtataaatatgttgaaattcgtgatcagcagtgtgattaccaattgcattgccttcctcataagctctttctacaaatttaatatgaggttctatataaggggagataatgaaaaatgttgcatgaacatcattatcttttaaaatatcaagtattagttctgtatttttactagggccatcatcaaaggttaggtaagcaattttttcatttggatccaaatttacttcacaatttgaattgcaagagaaaatattaaatatagtaaaaaaagaaattaaaaaaattataaaattttttaaaaaataaatttggattttttttattttataatggaattgattatttaacttaaaatttaaaatttcaaaaaaattaaatttttcatttgcattgtacatatcataaactctccttgtattgatttcatatagtattttgtccaataatagtattagtttatgcaaatgtatatagattgattaaattttattatgaacatatacaaatataaggaatattataaattagaaagaattcaaggagattaagtgtaaatgaatccatatgaactaatcatgaaaattgatagaaaaatgaaacaagatcctaattttgctaacaggtttaataggttagttgcagagtttaacaggactcctggtttacaacaagaagtaatgagaatagcgcaaattcaagacgagaaaaaaagaaaaaaagctctagaaagtcttcctgataatataaaacaatcagttgcagagatgtttaggctattaaatagttagatttgttagaacttaaataataaaaagtaaccaatttataaaattggttattttttattgttttatatagaaatgtaaagaggaagatagtattataactatatccataaaataacaaaaatgaaaaggaagttaaagggggaacaatggtggaggttaacttaaatacaataaagataaatgataaaataaaaataaaagttttagatttagtatggtttttacttataccaataataaatataaattattatatagcaggtacgattaataaaaatggacatgaactcaacactatgtttgatgaagttattaagtttaattcgatttttataattccctatttatattggtatatatatattgtaataggttttatagttatattaatacaatcacgagaaaattatatgagaacattcttatcgtttttcattggaatgggaatatgttattgtatttattacttttatccaacagaaattattagaccagatgtaagcaatacaaatatgttaaattatttagttaatattatttattgtgtggacagacctgtaaattgttttccatctttacatgtattaacaacttattttataatgcgatatactaaatatgaaaaaactaagaaaaaattctattatacacaaattgtaggaatattaataattttatctacagtttttgtaaagcaacattttgtagcagatgctataggggctatggttataggtgaagtaataatttattttataaataaagtaaatgatgagaggataaaagagattttaaatgcaccatataaaataaaggataaaatatcagaaaaagtgaaaactaaagttgctgatggagatgaaaaaaagtttttgtaaataagaagatataaagataataagcccaggagtatttaaagattagatgctcctgggctatttttatataaaaatataagaatagtttagtataaattaaaaaagatgagtaaaactaaaaacatactaaggaggaagagtaatatggagtttttatataatttttttatttatggtttcttaggatgggttttagaaaatgtttttagttatgttgttactggacattataaagaagatggttttttaattggaccatttaagcctatgtatgccattgctatggcttggattattcaattatataatgcttttcctaataagatatttttattatttatatcaattattattcctactactgttgaatacacaacaggtattataatgagaaaatattttaataaggactattgggattattttaatgaaaagtataattataaaggaataatatgtttaagattttctatggcatggactattattagtattttaactacagagtttttacaaccatttttaataatgagaatatattatatgataaagcctgtatggtctattttagcaattttattaataatattattagcttttgatgagatttatacattaataaaatttaaaaataaaggacaaattaatttaaaataaaaatttagatttagataagaagatactgttagtaatttaaatgacagtatctttttgagttttaaaattttaaatattaatatataataaagtaataataattaaaactgaaagaggtaagatatgagtttaattagaacatacgaaaaatttacaaatatagatacagaatttatagcttttattgagaaggccataaaagatgattttcaaagttttactgaagaacaaatgaaaatgaatttaaaaatagcattaaagaattatgaaaatttaaaatttgaaagtgatgaaattaatgctaaagatgatgaagaaaaaaacaatttaaatgatttaaaatatttaataatgagtggattatttttagtatcagatttacaacatttttatagtttaaatgaatatgaaagatttaaaatgagaggaataaattatataaataatagcagaagaaggaaagtggtttagagaggttaaaaatatgactatatcggatgatatagtcatatttttaattcttgatataattagataatatacgttgttcatttatcctacctattaattataaaattatattgtcaaccactataataaattttagcatttacaagaataaatctttataaatgtataaatataataaaaacagtaaaaaatatgaagaaaaatatatttttattataatttatattaaaaataattaggtttagaaacttttaattgtgtttaaattaaaattaaataaattaataattaagtataattgtttttataaatcagaaataaaatgtttaagatatatataaatagtaaataagtatagaagaattacatgagaaaatttattgcttaaagtgtttttatataaacaaaggagtaggtatgaaaaaaatattgataaatggtttttttatagtattattgatagaattacatgttgctgaagtaagtgcgagtatggttcaggttaaagtgcctgattcatatggtgcgccaaaaacatattatcaaaaatactttgatcatgattataatatagaagattatagtaaaaaaaatgatttgataaatcaagataataatgaatatgaaaataaaatagatttctattttgatgattatgattactataatcattattatgattataactattatgacgaaaagtatgattattataagcatcattattatgaggatgaaggatattaaatcctgatagtaagcgctagggaatttgacaaagaaagataagaggaataaacttatgataaatagtaccaaataaagaggtgaaataaatgtcaaattgtaattcatgcccaagtaatggcgattgtggaaaagaggaagaaaagtgtaatattcaaaataattcttcaaataaaataaaaaacattatagctgtaatgagtggaaaaggtggagtaggaaaatctactatgtctgtaatgttagcaagacagttaattcaaagaggatattctgtaggaattttagatgcagatattactggtcctagtattccaagattacttcatatagaagaacaaagagccatggggactgagaaattaattttcccagtagaaagtagtgagggaattaaagttatgtctttaaaccttgttgttgaaaaggaagacgaagctgtaatttggagaggtccagcaatagtaagtgtagtaaatcaattttggactggagtatattggggagagttagattacttaataattgatatgccaccaggaacaggggatgttcctttaacggtaatgcaatctattcctattaaaggagtagtaatggtttctattcctcaagatatgatttctatgattgtttctaaatctataaatatggctagaaaaatgaatattgatgtatttggagttatagaaaatatgagttatattaaatgtccggattgtgataaaacaataaaactattcaatggtgaaaatacagaaaagttcttgaaggatatgaatgtagaacttttaggagagttacctatgcatagagcaattactaattatggagctttagaactaattgaagaagaggaagaaattgcagaattatttgatcctatagttgaaaaggtaatagcaaaatcaaagaaaaaattaatgttataaatctttacttataaaagtatctaagttttgtgtagaataaaatgtaccctatagagtagacatgataaaaaagagtctaccctatagggtacattttaactaatgaagttacctcctaattttatttttattatataagaattattaaattgaaaagcaatatagaaatataattaattcccattcgattctatttcattactataatttttaccgataactctatcataagtaattaagtcaagctctacgtttctctcattagaactttgaatgcttggggagtaaagtggataagaattcataatacttttcatagtactagtgaactttgtatcctcacttccaatcatatcagttactacataaggaatgtaaaaagcagaaatagttttatcatcattatataaaatatttgaattataattgttccaaataatatatttttgagtatatattaattcagagttagtatctgaaacacctaatctgttataaacatcatcatcaggagtaaagaatggaaaatgatctcccacaaatactaaaataacatcttcatcaaaatctttaagccaattagtaaattctcttaaatcattacttgtttcttttacaccttgtaaataatatgataattgatcagcaccttcagcagtttcttcatagtaaggctgatgattttgcattgtagtagcaaaaatataacttggatcatcacttgattttagtacagattttatttggttaaacacactttcatctgaaatatatcttctaaatgtatttgtttctacagtcatattatcatcaaaatataagttatcaaaactatattgagaataaagggtttccctatcatagaaacttttactaaaaggatgaatataagtagtagaataacctaagtttttaaaatatttaggtattgtatcaattgtttcttgcttttttaataagttttgtggaactgatggtgtgttaattgcataggttggaagaccagttagcaattcaaattcagttcttgttgtgtatcctccaaaggttggaacaacacaatttcctacatatccttcagaagcaacttgatcaaatcctgagtatatatccccatctatattgagagaatcaaatactctaaaatcactaaatgattcagacataataaatataacattaggtttattttcattaaatgtcatattatctgaatttgtagttgtattatcagttgaattttcatttttagaagaaaataattcatttatagaatcataactataattttcaggcggatttacaatatccattaaattttcagaggtggtttttgccaaataaggcaaaaagcctatatcactaaattgttcgttactttctaatatattagttgcaacattagtttctatttcaaatactgaaaatacttttgcagagatggatgttgttaatgctatagttaacattgcacttatacttgcacaaatataaatacgcttttttagtgaaaaatctagaattaaattatccttataggtaaaaactatatatattattaaaattgctaagttaagaaccaaaggataagtaatttttaatgaagcaaattttccaacgtcgcttagattttttgtcattattaagtcactaataactaaatgacttccgctagttttatatttaaaatattctacacaagatagaatataaaatattccaccatgaattgccattgagagccatgctttatttatgataagaaaaattagtataaatagtattgcagatattaatatattaaataataagatatttggttttgttattaaaaaggtcattgtttcattgaaattctgacaaatattatattctaacaaaatagatatcattaatggatataaaataaccaataaatatttaaatatatttttgtagttaattttcatgatagaataataactcctttctcataatatattttgtatatttatatataacaaatatattatatacttaaatatctaattttgtaattgcgttaagagaatattaagagaaatttaattgaatatatattcattttctatgaatcggtataaaataataatattttaacaaaagaggagtgcttttttatgtttggaataccattgattgagtgggttggatatgcagcatcaataatgattgcaatatctttattaatgactgatatattaaaacttagaataattaattcaattggatgtgtgctttttgcaatttacggatttattgtaaaggcctatcccgtaggtattattaatacatttatattctttgttaatatgttttacatatataaattttcaaagaaataaaaaatatataacgtctttaaagtataaagctttagagacgtttttgtatattataaaaaaacataatattattaattatattataaaaggtgattatagtgtataattaaaataaatttataataagatataggtatttttaaatttatttcaaactataagagacaaaagaggtgcaatatgagtttaatggattcaatattagggttatatgatattatgaaaaatgattttggagaggaaagaaaaaagaaaagaaattttaaatatataagaacatattttgatatggaagaacatgatggatacactatagatgatcaaacttgggatgattttaacatggatgaagtattcaaaaaagttgatagaacatatagtagtgctggggaagctatattatataaaatgcttagaaatccacttcatgataaaaagaaattagatgaaagagataaatttatcgaagagctaagaagtgatagcgatttaagaactaagcttcaaatgatttatttcaagcttggatatgataggaaaaatacttttttagatatgataatggaaccacttgaggaaaataaaagtaaatattatttatatattttctttggaagagtattaatgcttggtactatacttttatcaatattatttaaggagccatattggttacttgcaactttttgtttattatgggtaaatgtatttattaatgataaggaaagaaagaatgttaagtcacagggattattatatttaagaaatataataatttctgcaaaaaaaattacaaagataaataaccctaaaataagaaattacacagatgagatggaaaaaatattaaaagaattaaagggaattgatagtgcaactaaaactattcaatttgctaatgttggtgggggagtttttgaagtatttactataccatttttattagaagaaacttctttttatagagtagcaagtttattaggagaaaaaagagaagaaattttagatttatattatttattaggtgagatagaaagctatatagcaattgcatcttataaagaagagataaaagataagtatactaagccaatatttaataatggggtaaatataaatatcatagacggcatacatccacttgtaaaaaatgcagtatctaattctattaagtttgaaaagagaggaatagttttaactggaactaatatgtcaggtaaatctacattcttaagaatgataggattaaatatgatttttgctcaaacttttaattttgtattagctaaaaaatatgaagcatgtttctttaatatagtatcatctattagtccaagtgatgatgttacattaggaaagagtttttatatggcagaagcagaagctttattaagaattataaaagcattagaattggaattaccagtattttgtcctattgatgaaatatttagagggacaaatcctattgaaagaatttcatcgtcagctgagattcttaaatatataaatagtaaagatagtatatcaatagtagcaactcatgatagagaacttacagatatacttaaggatgattatgaattcttctattttagtgaaaaagtagatagtaagggattaaccttcgattataagttaaaaaggggagtatctaaaactcgtaatgctattaaattattggatcatattggatacccaaaagaaataattaaaaagtcttatttaagggctgaaaccttagaaaaatatatgtaaaaaaacatggttatattagtctatattttattagctaatataactttttttattaaccttgtgtaaattttttctaaaggttaatttgtagaattactttatgttattaaagattaaaggggaaaatgtagataatttcatggaaaaaaatacctaaaaaagctatataataaatataggagttttttttatgagggaggggctattgtgaaaaagataagcaaattaaatataatagctatagtaataataggagtaatacttttaattataccaatttcaattcaagcaaatggaagagatgcaagtaatagcattaataaatatgtagctcttggtgatgaggttgcatctgaaagtgaagactattatgatgtatcttatgtgtcattaataaaaaattttttaaaggctttaaattcagatttagcttatagtaatttaagtatggaaggaataacatcatctgaattacttgacataataaattcaaataaagaggaaataaaaggtactggtttaattactatatccataggaggaaataatatattaaatgtcattatgaataatttatataataatattgatagcgaacatttaagtgaatatgatgaggaaaaatttgatgctattgtaagtgaatacttgaatagtgatgaaataaattcagaagttatgaaggaaatagatagttttgaaaaagattttatcaatataattaagcaaataaaaaagttatctcctgatgcagatatttatataaatactgtttataaccatattaataaaaagggaaatatatatgattactttgatgaaaagataagtgctattaatgaagtaattacaaaaaattatagtatatatgattatgaagttattgattgctataacattttaaatagtgatgaaaaattaaattttcaggttgtaaataatgaatttaaaatatatcctaataaagttggacatgcaatgatggcaactcaggttatatctgattatgaagattatgtaaatttagaagtagaaaaaatcacatcttctagcaataacataaaagggaagaccattccaagtagtaatgtaattgttgtatcagaaaatggaacagtggggacaacacaagcaaaaaagaatggtgaatttgagcttgagatatcacctatggtttcaggaactaatctacaagtattagtttatgataataatatcttctcaattttatataaatttcagaaattagtggttaaaaagggtttatttacatcgtaattagtttggccacatttgatatggacaatcatatttttctttcaatatggtaatactaagcttgaaatacttaggagtaattataacaaactaaagataatattggaggaaaaaagtatgaagaaaaaagttatatcattattgatttgttctgcattaatgatggtagaaggtgttacttatgcccaaactataactactaattcaagtgatagtaagactacagtagaagcacctgcagaagaaaaggaacaaactaaatctaaggaaacatctgaaccttcagaagaaaagtcttcagatgaaaagtgcaaaaaaacttctcaagatgatatagaagaaacttcttcaaacccttgcaagaagaaagaaaaagaagagaagaagaaggaaaaagaagagaagaagtgcaaggacgacaataagaaagaagaaaagaaaaaagaagaaactaagtgtaaggatgaatctaagaaagaggaaaaaaagaaagacgaatctaaatgcaaagatgagtctaaaaaagatgaagcaaaagatcaaaataaatgtaaatgcagagatgaagaaaaatctgcagaataatataaataaaacaatagagtctataaatttagactctattgttttatttatgacatatttcctaggaaattttatttacaacctcacttaaaactttacctatagaatcattaataactaaatcagccttattatcagccgaagttgaacttttatttataagaataagattttttcctttaaagtaatcaataagcccagcagcaggataaacaacaagtgaagttccacctataattaatgtatcagcatttgtaatggcatttacagcacctctaatgatattatcatctagtccttcttcataaagaacaacatcaggtttaacactaccaccgcatttagtacaagtaggcacacctttagattctagaataaatttttcgtcataaaaagcatgacatttagtacaataatttcttaaaacagaaccatgaagttcaaatacagttttgttaccggcagcttgatgaagtccatcaatattttgagtaacgatagcttttaatttacccatttcttcaagtttagctaatgcaatatgaccagcattaggttttgcatcgggatatattagtttagatttataaaagttaaaaaattgctcaggatatcttatataaaaactatgagaaactaattgttctggagtaaaagtaacattaagcttttcattaaataatccattagagcttctaaagtcaggaattccactttcagttgattctgataacgaagtccttaaatctgacataaatattcctcctgaacttctaaagtcagggataccactttcgcaactacatccagctccaccaaagaatactatgttatcactatttctaattatttcagcaagttgttttattttatcatccactaaaaacacttcctttctttatttctattataaacatttaaaataataaaatctatttcaagctatcaatatattaaaagtatcacagtgagctatagagaagtatcacaatgagccataatctaatacttactatatctatatttaacttattagtatatagtattagactaattggaaagtaaatttcctatggctttattttttaaattattatagtctactttagtttagtctatgcaaataacgctaagtgatgtataatgatattaagatgattcactgggaggtacttaaaaatggcaattaaaaatagaaagagattgagtacatctttaagttatgaacactttgagtttttaacagaagtatgcgataagaataagcaaaagcaaagtgtaataattgaaatgggattagagttattaaaaaaggaaatagaaaataaaaatctatatgagataatggaatcattagaaactgataagaaataaaaaaacttgtcagtttttatttttttactttacagtaacgtcactatgtgttattatatgtgtatagtaacgcataataacatcaccaagaagggagggaataacaaatgcaattcttaaaattatcttatgaattaataactgataaaaatatcacatctaatgaatttagaatatatacatatctaatgagcctatacaatgagaagctaggttgttcattcccttctatagaagtaattgcagaaagaactactatatcaatagcaactgtgaaaagaagtattaaaaagctagttgagcttggttatatggtagtaaaaaagcaaaaagcaaaggttggtaactttaataagtatactaactttaagcatttagcttcagataaaaaaacagtaacaaagatacaaaaaacagacgttaaaaatggaaatccaatagactcaaatgctgaaattccagtgaaaggacaaattcatatatctgaagtagtagaagaagttgaaaaagttaaaatattgacaccaatagaaagaaaggagtatgaccaacttaataatgcttcagttaggattgcaagaaaatatactgatattgatggtaatgggtatgtaatatcaatattagcttgtttagatagtgaaatagtaagagaagctggatatagattcaaaaatcaactagagttaggaaagcttaagttaaattgtgtatctaactttttaagagttgttgttgataaatattttgagaaaggggtagatttcccaagtaaagcatttaatatgcttaaaaaatataactatgttacgtttcaaccatctgattcgaaatcagcgatgattttagaagagagagaaatgtatatgaatgctcaagaaactagtgaggaatacgttgaaagaattaatagagagctacgattatcagataagataataggtagaacaaagtgtgttatagaaaataagacagaaacattagattttaatggaataattattggagataatattatagcttaaaataaaaaagcactcccaaggtggaagcactcttaactcgcaattaagattttaacaccttgataaatagaaagcaaggaggaaaaggtatgtcaatatattgtctaatagcctatgttgaagaagttggaatagaaaatgcaacttttcaggggttaagactatggaaaaaatcaaaatggagagattaatatattttaaaataattcaaatatagaaagatatgattggtaagtaaaatctaaaaatataacaagtttatatgttaagaaaaaattttaaattatttttcatatgatattaggtttgtagtaacaaatattaaacgtaagatgatattaaaaaataataatgtagaagttggatttatccaacttctttttatttaagttgatgattattttcatcaatttttttatacagtaggtttgtataactatatgtaaaacaaattaaattatgatcttgttttacgttttgaagcagtagattcggataatcctaatgtagaagaattttaaatataaaaaaggagaagtatactttatgaaaaaaagagaagcaacagtaacaattagatgtagcgaacaattacgaaaggaatttaagatagcttgtattgcaacagatacaaaagcaacggatgtaattgaaagggctatgaaagaatttattgaaaaagtaaatggaggtaagaactaatgaaaggattagcgacaagaaataacttaaacaaaaagaaagaagctctagaatcaattgaaaagttaaaagagtcttataagttagcagtaaaaactaaggaatattattcaaaactatgggaggaagaagaagaaaaccaatttaaacaacatagatacctagaaatttttatagattataaaagagtagaagaacaaactaaagaaaagttaatagctttattgggggaatgtgagttaacttttgaagaattagaaggttaaacaataagctaatgctggagtgacaaaagctccagctaggttatacaaaagatggaggaatttatggatagattagagagttataaaagagtattagcagatatagagagtggacatattgcttatgatagtaaattgttaagcatagtaaagggagttattagttcattatctcctgagttagaaattagagctatggatgagattagaaaatataagactcttaatgagttatggcatgaaagaggttatagagtatctaatggaattagtcttattgtagcaccttgtggaagtggaaaaacatattttacatttaatacattaattcaaggggagaaattagaaaatataatttacttgtgtgatacatcaaatcttaaaagagcagttagattagataaggactattcacatttgtgcagattctatagtaagaatgatgataataatgtagttaataactctatagagtttggtgaaggatttggagaaaacaaaataactgtaatgacttatgcacaatttggatattatgcaaaaagaaatcccgattcatttagaaagataaaacttattgtaatggatgaagctcatcagctagttgattatagaatgaaatttgataatgaagattcagatatgtatgaggttgctattgaaaagattaagtcgttaagtagacaagctaaggttgtaatgttatcggcaacacctgaattaataacatataataaaggatttaaagtacctactacttatgattttagtaatgaacctgaaataaaaagattaagagaaaatatagtaataccatatagaaccaatagagaaataaagaaagttataaaagattttaaaaaagttactactagaactggtgttaagatgttagtttatacagataggattgctactgtaaatgatattgtgaaaacctgctttaatgaaggggtaagggcagttggtctatggagtttaaataataaagaaaatgcaatgagtacacatcaattagaagtattagaatcagttgttaaagatggaatgattcctgataatattgatattttaataataaatgcttcattacaaactggaataaacataaagaataatgatatagattgggttctagtaaattcaactaataaaacaactcagattcaagcaagaagcagagttagaaaagatattgacagattatatctaaagtctgatgattctgaaatatctaatgatattgagttagatgaaaagtggttaaatagaccattaacttctaatgataagaaagaattaagcaatgaaattcaactttatgatgaaaggggaaggcttataaagtggaaggggttatcactaagattaattgagcaaggctataaaatagaagatttaacaaaagtaattgaagggaaaagagtaaggataagcattattaacatttaacacaacttaattataggtaacatttccgtgtctagctatatatctatagtaaatcacagaaatgttacctgaaaaatcactattattcaccagcgaaacttcgagcatttaaacttgaacgagcaaagcgagagaaagtttataatgtgagatgctgagctgagaggttaaaccgatagctttaagctcaaataatgagatatagagtcttaatgaaagtagcaaatagacaccttttaaagatgtataaataaccttattgtaaatgaaaagaaggagggaagttcactggatgcagtattaagttgcatcaaatatatacaataaggagataaaaaagattatgaaattagaagtgaatctagaattaaaaacgtttgaagagaggttggctcacattgaagaactggttgaaaaagggaaattaaatagtattacaaatggacaaaaggagtttatagctacatatttattaaagaaagctccaagagataaagttattaaaaagaaatacttacttatgagcaagaacgaatttgatacttacattgaaagacaaagggttggtttagaggtagacaatcctaatgagccacttaagatatttgtagctgaaaaaaatgattatataaatatggattggaaaattactgatgaggatttaatagaagagtctataatgggtttaatattaagacaatataaaatttacaagaatctattagatgagcttcagaaggatggaaaacttagtgttaaggcatatagaagattaatgagcaacattaatgatgatatgttacttactaaacaaatatgtaagagcgctactgaaaaagaaaaacctaaacagtggattggtgataaggtggactatgatgctattgattacactaatgagaatcatgtagaagctattataaggtatatatatttaaaaggagatataataccagacaatatgatgtgtttaatagcctatgatatattagttacattagatgaaatgaagaataaagggttgcttactgaggaagatataataatagttcatatgataaatgaaggttatacacttaaggaaattagttcaaaagccagaattcaagagagtggagtaagaaagagatttaagaggatttgtcagaagatatctagatacaacgaacaaaaaataaatacaaaaaaataaaaaaagttcgtttctttaggacaaatatatggaaaatatatactattaaaattgagggagggaagagctttcctcataaataggaacgaccaaaactattaaagcttcagtgatttttgctggagctttaattattaaaaaaaggagcaaggaatacgtgaagaaaaagaaacatcaattgttattgaatatgacacaagaagaaaaagaagaatttaaagtaaatgcagatagtaattttatgactttaagtcagtatattagatggtgtgttcatcagatgataaagaaaaataaataatagttatctaaaggctataatttcataataaatactaaggtatctccgaaagacaactaaattccatatttatagccttcaaatagctattactatttcctttcttgtagtgataactagtctaagtttcatattagaatctatctaggaagtgtaatctagtattattcataatactgattgtgttggctagagcatcattaaattggtgctctagattaagtattgatattgaaataaaaatagtaggagattatgtagttatagaaatataagtaatgattacaagtaaagagagtgatgaaatagataatataaatatgattataaataatatttgatgatgtgaagaaaggaaaaatagaagtacgaggttaaattctattggagtggttaacaatggtaggaatgaccttcttttttttatctttacacttaatagagtcacgccctgcaatagaataaaatatgtgtgcttttttattcaatgaaattaagtaagacagattagaacaattaaagataaaaggcatagaaaaaaacacgttaaattagtggttaaaatcacaatttctaacgtgtcttttttgttatgagattagcttagcataaaaataaatttattgtcaacagaaaggagtaaagttttgaaaaggatttataaaataacatttaaggttagttctgatgagagagaagcaattaatgaattaatcaaaagaaaacaatgtagtttatcagatgcaataagagaaagtcttcgtgaatattattcacttcatggttttgagggaagttatgatgttactgcaaatagagaagtaaaaaaagatagaaagtgggagctttactaatggaagataagctacaagaactacaagagtttcatagtgctataggtttcgatttagcagaaaaaaggaatgacttagagttattagcatcaaaagaagaaaggagatactttttatggctaataaagactataccaaacattacgaatgtagatattattccaattactacaatggcaatgttactagctacaataagtaagttaaatgcttacatggctaaatgtgagaataatgtagagctttatcttaaactattagctaagagaaatgaaagtataactaagctagacatgataatgaagagttatggattaaccaatacgacaaaagataaaatttttattgcatatgaaagtgaggaaggatgatgactaaaaaaatagttaaaaagaatagtaacagtagcgaagattatgtgtcatatctaactggcgactcactttttgatttgttgagagaattttataaaagtcagtatggattagatagtccagagtggaagtcaattgtagataatgatagaagaatacaactagagaaaaagcgtaagaaaattaatgctgatagaagatacaaataaatctaaaaatactaaagaaaaaggagaaataatattatgtcaaagaataaagtaagtaaaggtataaacacaaaaagaattcaacaaattgaaaattatgattatagcttatggaatttagtgaatccaaactttagacaacaatcaattttaaatccaataggtgctggagtcgcattaactacattacaagagcttagaaaagagctagacagttatgaaataaaattacaacaaatagactgtaatagagtttttggtaggaatatggagctcacagaaacagaagtatttattagaagtattaatagtcatctaaactatagaaatgactacaataaagttatgcaaactaaagagttagatagagattttccaagagaagaaagagagaaaattgcaaatgatttagaggaagaaataaaaaaagaatacagaaagattacaacagtaggaaaaattaataaaactcttagaagagcttcagaagccagagtagaagcattaggtgtagagttaagagatattttaagcacacttgaagcaccaaccgaggagtatataaacaatatgttatatctaatagcagagtctaagattaaagaaattaaaagtagattggattctaagattgcttacttaggctcagtgatggaggatatagcataatggaaacaagaatgaatgatacattagaattgagagttaaccagcaagagaaaaaaatatatcttgctggttatttaccagttaatgaattttctgaggtattgatggacaaagatggaaagaaatttagagagaaaattaatagtggttgcttcagtagaaagctgaaatcaatgggagaaaaatttcctttgttacttataaatcatgattataaaaatcaaataccagtggatgcatttgaatatgaagagagtggaaatagattaagaatactttatactttacctttaacagaagaagtaatggataaactaaaagattttggtgaagctaaattatcatttggatttacggtgctgaaggaaataaagcttcctaagaaaaaggatatagatagtgtagactatgaaagaatagtaactgattttgatacgttaagagaaatctcgattcttagaaataagctacctgcttactcccaaagtcaagcttttactggagatgaaaaatcagtgaaaagagcagtagcaaaagcagaaatttcagaaagaagaaaagagatagttaggttacaacagttagagatagataggtacaaggaatacataaataaaaagagaagaaatgatttgtttagatttggtgcaaatgtaaaaataccaatgaattaatcaatagggatgcagtagtaaatattgcatcccgattttttgctttttgtagaaaaaataaattttgaaaataacttataactataaaaatgtaggttgtaaagattatagaaatttgaaaatcaacagagagcctttaaagtaagtatttgcctagtgtttacctaattaaaatttggattttattgataaaaatgatataatcactctagaaaataaggaggatgtaactgtatgagtcaagtaacaaaagagaaggtttatttatatgctagagtatctactactagtgaggaacagttaacgagttttaacactcaatccaattacaaaagctcagattatgaaataatagaagtatttgctgattatggaaaaactgctaccaaagtatttaatagacccaatttcatagagatgctaaagagatgtaatgttttagtagagaagcacaaaggtaatatcatatttgttagtggcgagagtaaagcacaagtaaataaaattatagtaagccatagcagtagatttatgagaaatcaaatattaatgaagcaatgtttactggctttgcaacaaaacaatgtagaagttatatttttggacatgggaaggagttcatttgataatgatatagattttattcttaatgtttttttcttattagatgaacaagagtcaaggaatactcaatacaaagttaagaaagggttggaaaaagctagagagcaaagaaactatttgccaccttgtcaaaaaatgcttggatttgattatattaatggagagaataagttgatacaaaatcaagatgctcctaaagctaagtatatatttgaagcttactcagaaggcaaaagcatgagagagatagctaaggaaatggatatgaagcctaatagaataatggagattattagaaatgaacgttattgtggatatgtaggatatcaaaaatattactatgatgaaaaaagtgaaacaaataaaaaagcgagagaatatgatatagtaccaaatgataggattgaagcaatcatttctaaggaactatgggataaatgtcaagagattaggaaatcaagaaccttaagaggaaaaggggttaaaaatggagtctatgcaatgagtggcaaaataagatgtagtgtttgtggtaaaaatttcttccataaaggaactaataagaaaggcgatttatgggagtgtagtagtaagaagaataatggggattgtaatagtgcttgttttaatgaagatacacttaagaattttttattatctccaagaggaataaatgagtttaaattgactatagaacaaatcatagatgagatattatcaaagtataaattaaaagataaaagttctttagaaacaaagttagagagaaatattggaatattagatagaactaaggaactctatatggatggagaaattagcaaagagaactataacactagaagctcaaaactaaaagcagagataaaggatattgaagaagaaatagaaaatatagataacttcaattcttactatgatgaaacacatagacttaaagatgattatatagatatattaaattcacttaagattaaacttgaaaatggtgaatcagaagatgtatttaaaaatcatattgaatatattgtagttggtagagcttatgatgaagagaaagaaaagataataccaacagtagaagaagttaagtttaaagactttacgtcactatataaaatattagaaaaggctgtatttacgacaactggagtgttttaagcactcctttttttattcttaataatatagaaattaagtaaaattaatacatattaaagaaaaatatgtatataaatacaatataagtttgccttttaataatattatatattatacttaattatggaaaagtatacaattagaggggaaaagaaaatgagcaatttagcaaaacaaaaaagagaaaagatagaaggaatattcaagcaaatcattgaaagtacaacggatgataatactgtcatagcaataaaagaaatagaaactgaaataaataataaaaagtatggattattatgggaagaacattatgaacaagttgatttagaaatgaaaacaaaagttccagtattttcagaagatataagtagagaaattgtaagtcaagttgataaaaagtttaattttttattagaaggtgataatttacatagtttaaaattattagagaaaactcatagaagaaatatagatgtaatatatattgaccccccatacaatactggagcaaaagattggaaatatgataataattatgttgataaggaagatggctttagacatagtaaatggctaagtatgatgaataatagattagtaatagcaaaaaatttactcaaaacagatggagtattaatttgtgccatagatgaaaatgaattagcaacaactattctattactcaaagaaatatttggtccaaattataaggtcgattgtataactataatacataatccaagaggtgtacaaggcagtaatttttcgtatattcatgaatatgcaatttttgtctacaataaatcatataaagtaatcggaaatagagaacttgagcctgaagatatagattggtcaaatcttagaaattggggaagtgaatcagaaagaagtgatgctaaaaattgtttttatccgattatagtaaaagatggtgaaattattggttttggagatgtattagatgatagtgtacatccacaacagacggagtttatagaggaagaaggaagcttttatatatatcctatagatattaatggaatagaaagaaaatggagatatgcacgtcaatcagtagaatcgattaaagatttgttacgagttaaagagaataatggcagatatgagattgagataggcaaaaattttgcatcctataaaacagtatggacagataaaaaatatgatgcaaatgagtatggaacacaactagtaaatagtatggtaaaagataatgattttgattttcctaaatctttatataatgtttatgattgtttatatgcagttattaaagataaacctaatgcaatagtattagattactttgctggaagtggtacaacgggacatgctgtaatgcttatgaatgagaaattgggaggggacagaaaatttatactttgtacgaataatgccgttggagaaaagaaagaaaaagaatttaaaaatgtatatggtttaaaacaggaaaatgaaagtgaatggataggttgggaagaaaaatatggtattgcacgttcgattacttataaaaggattaaagctgcgataaaaggatatgaacatagtaaggatgttaaaactatattatttgaaaaaaagctcacaattaatgatttaaagaggtcagaaaaattactagagaaagttaataaaatagttgaagaaaataagaatatgtatacacaagtgaaatccataattgaaaatggaaattttaaagttttgggtatagtaaaaaaaggaattaaagttaatggaatgttggaaaacttaaaatattataaaacagagtacattgacaaacaagcatatgatgatgatggatatgatgtaaaaagtaagttattaaatcatattactgagatggttcaaattgagcatggagttaggatagatggcgaaacatataaaataatttttacagatgaagaaattgatatgtttactgctgataaaacaaatttaacaaaatgcaaaaaggtatatatatcatcacaagtactattaactaaagagcaagaagtattatttaatgagttgggaattgatattattttaataccagaatattattttagaaatgaattgagagaggtagaggagatatgattggattatcaagagggctatttaattttcaagaaaactgtgtaaaatatttactttattcttcattaaatcctaatggaaaaataacactagtaaaagctccaactggttccgggaaaactttaatattaatagactatatagataaatatatagaaaatatagattcaaaagtggcatttatatggctttgtccgggaaaaggtaatttagaagaacaaagcatgaataagatgattaaacatttaccaagtagaatagctaaaaacctatatgaagttttaactatgggatttgaagaaggtgatactgcatttataaattgggaattaataacaaatgttagaaataaagctatcactgaaagtgaaatgaaaaatttatttgagagaatagcagaagctcataggaaaggaataaactttattgtaataatagatgaggagcattctaacgatactaaaaaagctcagaatattattaatgcatttgcaccaatatctgaaataagggtttcagctactgttaaagagaataaattaagtaatttttatgagatacctgaagttgaagtgattgatgctggattaatttctaaggctatatatataaatgagggagtagaagctaatatcaatatagatagtgaacatgattatttaattgaaattgcagataaaaaaagaaaagaaatagtaaaaagatataccgaagttggaaaaaaaataaaaataaatcctttaatattaattcaatttccagatatgtcagaagagttaatacaatatattgaaactaaattagaaactatgggatatacttatgaaaatggattagtgtcaaaatggatgagtgaagatagtgataagataaataaagaaggtattgaagaaatgaatgcaaccccaatatttttgctaatgaagcaagctgttgcaacaggatgggattgtcctagagcaaagattttagttaaattaagagaaaatatgggagaagattttactatacaaactattggaagaattagaagaatgcctgaagcaattcattataatgatgaagtgttggataattgttatttatatacttttgatgagaagtataaggaagctataaaacaagaaatagcaagtgcatttgatgtgaaacgtgttattttaaaagaaaaatgtaagacatttacgttagaaaaacaacttaaaaatcttgattatgatggattaggtgaaagggaagctttcataaaaataaataaattttttactgataaatataatttaacatctgatttaaataagaataagcttattttagaatcagaaggttatgatttttcggcagaactaaaaagagtagcaagacaaggtaaatttattaaaacaagttcagtgttagatgtagaaataggctcatttattgaaacacgtagaatggtaaatacacataaaaatggtatagatttaatgcattcaattgattcaataaaatcatcaataggaataaaacatgaaaagttaaaggctattttagagaggttatttagagaaaatacgtataagaaagataaattattgaatcttaaattaaaagaattttatgcattcattataaataatgaacaaaaattaaaatgtgattttagagaagcaacaagtcaattaggaattcaaacttctttagtattaaatcctaaaacaaagccatttactattccagaagttgatttaatcaaatatgatgcttctgaaactgatgtagtagaaatgcttagcaatgcatataatgagtatccttcatcagttcttgttgatggtattcgttcattacctgaaagactatttgaaagatattgtgaaagcaataaaaatgttgattgggtttataaaaatggagatactggacaagaatatttttcagttgtctatgtagatagcatacaaaaacaatggctattttatccagattacatcgtaaaacttaaaaatggtgatgtgtggattattgaaactaagggtggagaaaagaaatacggacaaagtaagaatattgatagacagactgaaaataaatttgaagcgtttaaacaatatgctaataataaaaatataaattggggatttgtcagagataaaaatgagcaacttaaaataaataatacaaattatacagaaaatatgaatgatgaaaattggaaaccaatatcaaatgcattttaagtaatatatttttagaatataagtaattatatacttatattctattttttatgtactttgttgctagtatcagttgacattccagctccaccaaagaagactatattgttactttcttttagcatttttgttaatttatctatttcagcattcataaaatcaccgaccttttataatttatatttttattattgcacaaataaatgtaaaaataaaatgcattaatcactttttcatatttatatttgtaatgagtaaaataaagtgtagaaataaattagaggtgaataaaatggcattaagacaacttagatatgaaggcgatgaaattttaaggaaaagatgcaaaaaagttgaagaagtggatgatcatataagaatgatattagatgatatgcttgataccctgcataatacagaagatggagcagcaattgcagcaccgcaagttggaatattaaaaagacttgtagtaatagatatgggaacaggtataattaaattagttaatcctgagattattgaagaaaagggcattcaagaatgtgtagaagggtgtttaagtattcctaataaatatggtaatacaattcgacctaagaaagtcacaataaaagcattaaatgaaaatggagaagaaataattttgactggaagaggggaaatggcaaagtgtttttgtcatgaaatagatcacttagatggaattctttttatagataaagttactaaatggctaaaattaaaggataaataaaattatgtaaaagggatatttaaattaactttttttattttagcatatgtgttttatttaacttaaccatcagaaaagatgattactagttttttctgatggttaagttttaaaatttatttattagattcccaatgttgatgtaaagtattaaaaatagatcttaaagttttgccaatttcaagataactttcatcattcaagttagcaagagaaattcttaaaccccatctagaagatgcaaagccatctccatttaataaaataatagaataatttttagctaaatcataaaggatgtcaaatggtgtataattttcctcaatgaacttagcaaaattaattccatactcaattctagcccaatctaatatatttatttcagtataataagaagcataatgagggttattaaaaactttaagttctaagccttcacataatagttctttacgtcttttacaaatatcaatagtaaggttcttataattattttctatatcaactaatgcaaatccacagaaaaatgccatttgtacttgttgtggtgttgaaagacctgcagtatgatttaaagcaacttgtctactatcagcaactaatctatctataaatgataattcttcagggttagaagataaatgacagtaacgtttatttaaagtatctttatgtttttcaggtagttcacctataagtttattataaatattattttcgtttaatattattgcaccaagtctccaaccagttacaccgaaatattttgataatgaataaacaccaatagtattataaggtaaatcactaattatagatttaaagttattaacaaatgtgcaataaacatcatcagtaataatcattaaattaggattatatttagttacaatattttttagagtatttctgcaatgatcatttagtgcaatagatgcaggattgtttggattcactataaatagtgccttaatatttttatcttttaatttatttaaatcatcttcactatactggtaagtaggaagaccattttcatcaacttcattagcatgaatatttattacatcaaaattgtaatgaggtaaatgtggtatttctaaataaggagtaaaaataggcgtcataagagctattttgtcacctttattcaataggtgatttttttcaagggaatcaaagatatagcacattgctgcagttccgccttcaaccccaaagacatcaaaattattttcaaatttaatattaccacataattctttaagtaaatatttatttacaagtttttctatatttacgagcatcctatcagggacaggataattatcacctataattccatcagccaattcaaaaatccattcatcttcattaaatccaagattattaactccataatcataaattttttgtattaaattaattccaggtagtgaaggatttgcattaatatattttaataatcttttagcaatgccgtttttttgaaccataccagctagagcattaatatttaatgttctttgagtttctaatattgcaaattgaccaaaagtaaaaaaagcttgtctaggttcagcagcagtccaatttggatttcccctaccagcatctaagattgtactattatttaaagaagctaattttaataatttatctttaaattcaaatggacttacagttccataaatattttttaatttttcttttgttaattctatattcattatgaatgcctcctttcaggatgtataaatactgaaatatttcttgcaagtattaattttataatagaattagtaaaattaaaatagaaaaaataagttttagtaatataataaaaaaagttaaaataaatatgaaaaaaatagtaaattgatataaaaatattagaaatttatttaaattaataaaagtaggaaaataattattatattataaatatttaaggtataaaaaaaggtgcatgtataaatgcaccttttttaatgagttaatacttcaattccagtttctgttaccaatactgtatactcccattgcgctgaaggataaccatcttcagttaatgtagtccaaccatcatcagaatctataaatatatctggttttcccatatttatcattggttcaatggtaaataccataccaggaactaataacattccagttccttttttacctacatgagaaacaaaaggtgtttcatggaattcaaggcctataccatgaccaccaaattctctaacgacagagtagccattagcttcagcgtgagtttgaacagcttcagctacatcacctaagaatccccaaggttttgcagcagctaatcctttatctaagcattcttttgctactcttactaatttctctaaatcaggatgtacttgaccaatcataaacattctagaggcatctgaaaaataaccattatatatagtagaaacatctacatttattatatcaccatcttctaaaataacatcttcactaggaataccatggcaaacctcatcatttaatgatgtacaaacgcttttaggatatccttgaaagtttaatggagcaggtattgcaccttgtgagactgtatagtcatgaacaatagtattaatttcttcagttgacattcctgctttgattttactgctcactaaatctaaaactgcagtatttattgcagcactttctttgattttttctatttgttctggtgttttaataatatttctaggtggtactacatgaccttttaatttataagagtatactttttcatcaaaggccaaatgacagtttttgtattttttattgctaccacaccaacagtggtcatttctacttaagttcatatctttatctccttgttactatttatatattttcattatattactttattaataaaaaggaaaactattaatataaatatatgatatatatataattttatttagttaaaaactatttaattatgttataagtatactttataatatagttagagaggaatgaaatggaaggtaataaaaatgaaaaaaaacttaattagaaaaaataatttaatatacaaggcttttatgatactaggtataatattagttttgtattatttagttttaaaattaatgtttggatttatagcattttctagtatgttttgcatgttaggaatagttctacttatttatggatttatagagttaaggtttcaaataaatatatggagtaagattcctaagataataagaggtatagttacagtattatttataattggattagttttatttataagtctagaaggtcttataatatataatggtcatcatgttgatactgaaaagccggattatttaatggtattaggagcaggagtaaggggaacaaaaattagtacatcgttattatataggttagaaacagcattagattttcatgagctatatcctgatgtaaagataattgtatctggtggccaaggtgaaggtgaaaagattagtgaagctagtgcaatgaggaactttcttgttgataatggagtagattcaagtcaaataataatggaagataaatcaactgatacatatgaaaactttttatatacaaagaaaatattagatgaggaaagtgaagtagaagctcctacagttactataatatctaataattttcatatgtttagagcaaagtttttagctaaagaagttggatttaatgttttaggatatccagcacaatctcataaagtgtcagcagtagtattttatgtgagagagttttttggagtaataaaggcttttatatttagaagataataagaaaattgagaagattatattaaataaatcttctcaattttttataaaaatttaagggggaagtaataaatgtatattattgaaacaaataatttatctaaatcttatggtaaaaatagaggaataatggatgtgaatttaaaaataaaggaaggtgaaatatttggatttgtagggccgaatggtgcaggcaaatctactacaataagaactttgttaaattttatttttcctacagggggaagtggaaaaatatttggtatggatatagtaaaggaaagtaaggatattaaaaagcaaataggatatgtaccaagtgaagtaaaattttatgatgaaataaaggttaaagatataattaaatactcatctagtttttatgatggaattagcaagaatgaagttgataagctttatgagttacttgaagttgatgttaacaaaaagatgtcagagctttctttgggaaataagaaaaaggtagcaatagtacaagcattaattcataagccaaggctattaatattagatgaacctactaatggattggatccattgattcaaaagaggttatttcaattattaaaaaaggcaaataatgaaggggctacagtatttttctcatctcataacttagtagaaatagaaaatttttgtgatagagtagcagtaattaaagagggaaaaatcgttgatactgttgttttagaaaagttagctaaaaaagctgcattaaagatagttttaagttgtgaaaatatggatgaagctttgataagaaaaattggaggagaagttctttcaaatgataatgatgaatttattttcttttatagagatgatataaatagtttagttaaaaagctttcgtcgtataagatagataaattattaattagtgaacaaacactagaagatacatttatgaactattatgaaagcaagggggatatataatatgaatatttttaagtttgaatttaaaaggctattaaagggaaatatcatttgggctttagtgtgtagtgttttaattataatgtttatgctattctttccaagtatgaaggagatgggaatgcaagagttagtaggggcaaaattagaagctttaccagaagcttttctggaagcatttaatataagtggatctactgattttagtaatatttctgatttttctgcttatgtgcttcaatatatagtaatggcaggtggaatatatgcagcaatacttggcgtatcatctttagcaaaagaagaaagtgaaggcactattgaatttttatattctaaacctgttacaagaaacaaaatagttacagcaaagattttagctaatgcatttatactttttatatttataattatagtttgtattataactataatgtcatctataatcgttaaaccagatgatgcaaaatttgtatcagtgtttagagatataaaggatatttatttaggaatggctttaatttcatatatatttatgacaataggttttttaatatcagtttttgtaaagtctgcaaagaaagctacatcaatagcattaggaatgttttttgcaagctatgtattaggaatattttcaaagcttcaagatagattaagtggatttatatatttatcaccatttgattatgcggctccatcaaatgtaataaaaaacggatttgaagaaaagtatattattatagggggatgtataatgattatatcaattgttggaacttatataatatacaataaaaaagattataatatataacaatgatcataattcaatttgagaaaaaataaataagcatgttttagttaattagaatttgataaattcaattttagataaatatttaaggaaataccaccagttataaatttaaaatggtggtatttttaataatatggaaagtaaatgaataaaaatattgataaatattaatattaactatatgaaaatttttttgttataaattatattaaagggggtagacggtatgagtagtgagttcatatttaatgaagatataaacaaaataataactaaaagaaaatcagttagaacatataagcatgaagagttaacagatgaaatattaaataaacttaatgaatatattaaatctttaagtggaccttttgatgaaaaggtaatatttaaaatacttgattctaaagaacatattaatggagctaagcttggaacatatggaataataaaaggtgcaacaaaattcattgcagcaaagataaaggaaggggaatttgcattagaagaattaggatatgaaatggaatcattaattttatatgcaacatctttaggattaggcacttgttggattggaggaacttttaaaaaaggacaatttgctaaggcaatggaagttgagtctggagaaattttacctataatatctccaataggatatgaaaatgaaaataaaagctttgtagaaaaaacaatgaggagattttcgaatcctgctcatagaaagccatggaataaaatcttcttctttagggatttttcatgtcctttaactgagcatgctactttagatggattcaaagatgcattagaaaatgtaagattggctccatcagcgttaaataagcaaccttggagaatagtaaagcatggagatgattttcacttttttatttctaaggataaagaggaagctaaagaaggatatgatattaataaaatagatttaggaattgcaatgtgtcactttgatttgacttgtaaagagcttggaataaatggaggatttaaagtaattgatcctaaaattgaagaagtaccaaagcattataagtatattattacttggattaaagaagagcaaaatgggcgaatatgagaaattaactataagtatagttaaaaatacttttagtgtatgtaaataagtaatttggataaaataacgttagagttaattatatagtttatatacattggaggttattaattatggcttttgaaaaattagagaacaaaattaataaaattaataaaaagattaagcaaggaagattatctcaagagattgctgatgaaattagtaatgtaattaatgaagtagaagagctaggcgatgaagcaaaagataaatttaaaagtgcagtagacgatatgaaaaaatcattaaaaaaaatgaagtagtaaaggagcgtatgagtgtatgctcctttatttttaatatattctttgatttataagtaataattatgaagtaaattccaatataagaatatattaataaatattttgggatatgttaatatattaattaagtaaaagtaaataatatgtggggtgtgtaatgaataaaaaaagtgaaattataactgctgtattagtagttatagttgtaattggggcattaatatttgctaacgcaaaaggaacgttaaataagagcaaaagtatagttgatgaaaaagatattattacttcgagagatagtatagttaaagagtttataccaagtgatgattttattaaatttaatatagatgcacctaatgcgtctttagagattataaaaaccaatgaaaagaaaataaagattcaatgtactaataatgataatagcaaatataaaataaagcaaaaaggtaatgatataataattgagaaaaaagaaaaattaaaattacttaaatggaatattaaaggagataatataaaaatagaaataccaagtacgctaatagcaagtgttgatgcagatacttctaatggagcaataattttaaatggtattgaagcaaataatattgatatggattcaagtaatggagaaataattatagaaaatgttaatactaaagaagatataaaaattgaaacatctaatggtggaattgaagttacaaatgtatcagcagaaaatattacgttggattcaagtaattcacaggccgtattaaataatataaatggaaaagaaataaatgtagatacatcaaatgcagaaattaatgtaaaagaatgtagaggtgacaaagttgtactagatacttctaatggagagatagaagtatatgaatgctatgcgaataatataaagttagatacatcaaatgcagaaataacattagaaaatttaaaagataaagagtttgtaatagataatttagaggtaagtacaagcaatgctagtgaaaatattaatgcaaattataataataaaaagtaagtaagcaaataaggagaatttataatggaaataagaaaagcaactatagaagatgtaaatattatagcgaaatataactataatttagcacttgaaacagaaaataaagtactaaatatggatacagtaactaagggcgttgaatcagtattaaaagattcaactaaggggatttatcatgtatgtgaaatagagggacaggttgtaggtcaaataatgtatacttttgaatggagcgattggagagatggaatatttttatggattcaaagtgtatatgttaataagaactttagaggaaaggggatatttaaaaatttatataaatatataaaagatatttgtgataatgataaagacatttgtggaataagattatatgtagagaaagaaaattatacagctcaaaaaacatataaaaatattgggatggataaatgtaattattatatttacgaatatgaaaaataaattgtagaaggttaaagataattttaatattcataaagtgaacaacaaatatatatatatgatataaagaaatagggggtgaaagtaaaaatgaatacagcagaattaaaggcaaatgcaaaagagcagttaaggggaaaatgggcagtggcaattggtactgtattagttgcaaatatattgattgattcagatgtaatgtataaagttagtgaaaaatttggcttgtttggattaagcgtatcctgcagtttaatatcattattccttggaggagttctttcagtagggctttgtaaattcttgttagatatggcaactaaaagagaagaaccaagatttgaaactttattttctcaatttaatatttatcttaaaacattaggattaaatatacttattacgttagcagtatgcataggtactatattatttatagtaccaggaataattgttggacttatgttttctcaaagttattatattttatgtgaagatcctagtaaatctataacacaatgcataaaagaaagtgttgatatgatgaatgggcataagtgggatttgttttatttagaattaacatttataggatggtggctccttacagcaataactattggaattgcagggctttgggtttcaccatatgttaaagtaactgaagctaatttttatttaagtataaaaaataattaataaagtcaatgcattagaggttatataatttaaaattatataacctctaattttttatgtatttaatataaaaaaaataatgtataaaatgtcctttaaaatttgtataattataaaacaatataatttacaattattaattttaaaaaggtgtgtgatatcatggcaaaagaagcatgtgataacagagtatatatattaactagcaaactaatgtatctctttataactaatatatggtttttaataagtatttcaccatttatactttatttctttttatcgggtgaaaatttatctattccaatattaacattcataggaatattattaggtccagcgttggcaacaatgttttcggttacaggcaaggtaatgaatgataaagaagaaaatgcaacaaaagatttcattcatttttataagcttaattttggacaaggtatatttattgcagctattataaatataatattaatggtttgctatgtagatataggattatttttttcaagtaacatgaagtttatttcttatatattaatcgtattagctatatttatgggagcaatatgtttttatgcttatccaagcttagcaagaataaatgtaaaaacaatagatatatttataaaatatctacaaaattagtattcaaaaaattatatataacactaactaatatatcaatattgataattggtgtagcaatattgaattttactaatatttcattaattgcagtattatttggtggaagtgcaatattctattttatttaaaaaatggaagaaaatattttaaaagatgtagatgttgagttaaaagaaaaatattgaaaataaaaaaagatataagtaaaattttttacttatatcttttggtttataataattttaatgagtttattgaataagtataaatctttaatagaattagtaggagttaatgggcataaaaaagtattccaattggaacttaattcttgttctgaaataattaaattaccaaaccatttatttttacttctttataaaggttaatgtgaactattaatttttatttataatacatattacttaaagctttattaatgaatttctttttttgaaaatctattacatgtaataaaataagacataagtagtactgtaattgcaattaatattcctaaaatagttaatattgtaggatttaaagttatattaatttcagatagtatgtctagtaatgcagtagaaaatactataggaatcatagcaataaacataagaacgtatctaccattttcaaatcctagtaaaagggtagctggcattaatattgatgtaaaaaatataccaataccaacagtagccaatggtatagtatataatggcaaagaagaaactaaatcatttattcctaatatctttacacttacagatagaattgttgatattattaccgcaataactgtgtttaataagcagtatatatatttagataaaatatattcatttgttttaactggtaaagaatatattaaataattcattttgcttctttcttcataaaaagtaattgtataggtagccatcattaaatacatggcaccggcaaaaacaatcatagttggttgtacagcagcaaagaatattccaagcgctaagataataagtaaatttttctttatagctagtaatgaattaaattgaagttttagtaaatttccaatattattcataaattactccctcctagtgtaatacaataaaatatcttcaagagtacatttttcataaattgcctcatcgccaaaaagttcataagcttttcttctatcagatattaaaccttcaaatccaaaggcgtattcttttaatgaaataaattcattcttaatactattatcaattaaatcctttttgctttttacaagtgtatgattatctaaaatttcatccttttcacctttaagaagtattttcccattgtatatcataactatataatcagcagatttatctaaatctgtagttatatgagtagagtaaaatacagtcatattatctatttccatgtggtcttgcataagttctaaaaattcatttcttattataggatctaaactagatgttggttcatccattattaataattttggatgatgagataaagccattataagttcaaattgttttttttgccctttagataaatctttatactttttagagtcatttatttgaaatttatttatatattttttatataattcttcatcccaattagaataaaatttagatattattttatgaaggttaactaatttactttcttctaagaatccagattcatcaccaacataagcaatgttttcttttgttttagtatctttattgatatcggaatttagtatttttatttcgccagaatcaggtttaatcattccaagcaaagatttaattgtagtagttttaccagagccatttggaccaataaatccagtaatatatccttttggtatatcaagattatctatagttaaagaaaaattcttataatttttttgtaaattacgaatttcaatagaattcatatttatacctcctcataaatactttttaaaatttcaatacattcatcaagtgttacccctagagctttagcagatattatgacagcctcaagtttatcttccatttcagccatggcagcttctcttaatctttcagaatttgaaccggaaacaaaggttccttttccaacaactgtttcaataaagccttctttttctagttcttcataagctcttttagaggttatgatacttactttaagctcttttgctaatgatcttattgatggaagtggatctccaggttttaaatttccattcaatatttgattttttatttgagtttctatttgctcataaagtgcaattggtgatgaattgctaattaatatatccaagtgttcacctccgtgtataagtgtatatatatattatatacatataatatcaatttgatgattaatagttaatgtagttttggaaaaatattacaaaacaaaaagagattagtttactaaataaaataatctcttaactttaaatatcctagaatttataaatatgaagatgttatagggtttagtcatcactgcaaacgcaaattgagttttgcaatgctatatattcctctttacttaatgatttaatatatttatcaaaatgatcatcagaacaaaaataacctattttattttctaaaaaacttttatctaaagtttttttgcaatataaacagtgtttcattttatttacctccaatatatgttagtgtgaaaaatttgcttatatattattcaaatttatgattaaataatgaaatattttttccaatgattatgcatttagaattagcaccatgaccaatttcttctgttttagcaattggtaaattaggattatctattatacttactactaattcttcaatagtaggagttatattattttcttgcattttactaaaggtgcctagtattagcccttgaattttatcaaatactcccatttgcttaagttgatttaaaaaggcagacataagtccagcttctccacccatactttctaaaagtaaaaccttatctgtaaagtcaggcatatatttagtaccagctaactttaaaagacaacgaatatttccaccaacaacaattccttctatttttaaaccttgaataaagttataagaaaagttaaataaatcatcctcattattaaataagctattagtaaagttagaaatctgattttcactatctgaagatataagatttcttatttgataaagataaacaggttttttagtttgagaataaatagaatttaaaaccgtagttaaatcactataaccaaagaagggtttaggatttttagatatataatcataatctaaataatctaaaacctcgtttgcaagatcaccaccagagatatcaaagatagcttttatttcattatttttatataaatccataaaggcttttcccttatctttagcagggccattaaatggagatgtggtttcatatatgtagttactacaaataggatttaagtttaactgttttaaggtttctaataaattatcaattttagatttattagctataggctgtccatttgaacaagcaactatagcaactttatcatttttatttaatatagacataatttttcctccattataagaattaatttatattatagtagcactaggaagttgaaacttcaattaaattaaatgattataaattagtctacatatgaagtatggaattaatgagctttgcattaatatagtgtgtgaaataaattattggccaataaaattaaaattaatcaaaaacttagttaataacctgctcttaacttaataatatataaggggaggtgttttaatgtgataaaagatatagtgttatatttagaagatttgaattttgtatctataattcttagacttactatggctgtgatttttggtgggataattggctatggaagagagagggaaagaagaccagcaggtcttagaactcatatactagtatctattggagcaactcttgcgatgataacaaatatttatatgtataaaatatataatggatatactgatccaactaggcttggagcgcaagtaataagtggtattggttttttaggtgctggtactattatagtaaccggaaaaaataaagtaagaggattaacaacagctgcaggtctttgggcatgtgcatgcatgggactagctattggggcaggattttattcaggagcacttattgggtgtttatttatttcagcggttacggttgctcttgcaaatattgataaaaaaattaatagaaattcacgcaatataacattgtatatcttagtaaattcaactacagcagcatcaaatttattacaggacatacaaagtaaaaatgtaaaaattagtgatatagaaataagtaataataatgtatcatctaatgatttgataggaattttgcttggacttaagatatcaagagaagtatgccattatgactttatagaatccattaaaaataaaaatgaagttattttccttcaagaaataaattaggaaaaaattaaagtgatttagagattacataataactgttgaaaactgaattatagtaagttttcgacagtttattttatgttataattaattaatgttttgtataagtaaaaggaataaaggagaagatatgagatgaaattagatattgtttgaatagcaaaataaaagtttagggagagaaatataataggggagattaaatatgtattattcaacaagatattcatcaccattaggagcaataacaatagctagtgatggagaaaatttaattggattatggatagaaggccaaaagtattttggtggtactgtatctgaggatatgattgaaaataatgatttaaatatatttgtaataacaaaaaaatggttagatagatattttgcaggagaaaaacctaagattagcgaattacaattagctccaagtggaggagagtttagaaagctagtatgggatattttatgtgagataccatatggagagatcaccacttatggggaaatagcaaaaaaagtagcttttaaaatgaataaaaaaagcatgtcaagtcaagctgttggcggtgctgtaggacataatccaatatctattattattccctgtcatagggttataggtgcaaagggaaatcttactggatatgctggaggaattgataaaaaaataggattacttgagcatgagggagtagatacttctaaactttttatacgagaaaagaggaaatcttattagaattacactgtagagagttagatttatgttaaagatataaagttaaaagccttgatattaaataatatcgaggcttttaacttgttagatatataattggtgccggcagtgggaatcgaacccacacggttgcccgcatgattttgagtcatgtgcgtctgccagttccgccatgccgacctaattaatatatacataatattaccatggtgtagtgaaaatgtcaatatattttagttcaaaaatgtggaaaaaatttaaagtgaaaatattaaacaatgaataatttaataaaatttagaacatgttgtaggattttagcatatattgctcatatgatgatagaactacgaataatgaaagggatacaaaggtatggaatggtttatgggcttaagtccaattatacaaggtttagtggctacaatatttacatgggcgataacagcacttggagcatgcttagtatttttctttaagactgttgataaaagaatattaaattgtatgcttggatttggagcaggggttatggtagccgcaagtttttggtcattattaaatcctgcgatagaattgtgctcagagcttgggtacagccagattatattgccatcaataggattttttgcagggggtatatttataatattagctgataaaatgatggatagatattcttatggcgtaataactgaaagtgatgaaatagcaagggactcagtggtgaaaaagtataagaagagtatattactagtagttgcagtaactcttcataacataccagagggattagcagttggggtagcttttgggggagtagcagcaggtataccatcagcgacaataggagcagcaataagtttggctttaggaatagggcttcaaaattttccggagggcgcagcagtttcgctacctttaagaagagaaggattatctaggaaaaaaagtttcttttatggacaagcatcaggaatagttgaaccaatagcaggagtcttaggtgctatagcagcaattagtgttagaagtatgttgccattttttttagcgttttcagcaggagctatggtgtcagttgtaggttcagaattattaccagaggcgtctattgaaaataaaggattaacaactataggattgatattaggatttataacaatgatggtattagatgtagcgctaggataagtgaaaataaagaaatagtaaaaggatgacactgaagtgtatcatcctaattacataagctttgatagaaagtttgtttcgagagttaaaattttataggaaaattattcatcgtagcattcagaagaagcagcatgtatagatatgaacatttccttaccaggttcatatctagctttagttctagcttcttcattagattttaagtttggagcaaatccatcctcatcgccaacaccagttgagtaattttttgtttaatgaaaattattatcaatacatttgcttttagtatatcaaaataggtaaatatatggcaagataaatgataatgattattaatttcattttagaagagttttcttaaggaaatattttcaaaaaataataataaaaattagcaatatgataaaaaaatctaattttaatattgttacagattgattcatctgttattatatagaagtaggatagatttatgccctgcggggtaaatcttgacccagttaggtacggtctagatatttacatatatttaagacaagctataactaatattaattagggaggaataaatataatgatgtattcaaaagaagttgaagaaatgtgcgttgttgctaaaggcgctaatcatgcatgtgctccaattccagttgaaggaaaatgggtacaagctacacaaatatcagatatttcagggttaactcacggaataggttggtgtgcacctcaacaaggagcttgtaaattaactttaaatgttaaaggtggagttatccaagaagcattagttgaaacagttggatgttcaggaatgactcactctgctgctatggcttcagaaatattaccaggaagaactatattagaagctttaaacacagatttagtttgtgatgctataaatacagcaatgagagaattattcttacaaatcgtatacggaagatctcaaactgctttctctgaaggtggattaccaatcggagctggtttagaagacttaggtaaggggttaagatcacaagtaggtactacttacggaactcttgataaaggaccaagatatttagaaatggcagaaggatacattactaaaatcgctttagatgcagataatgaaatcatcggttataagttcgttcacctaggaaaaatgatggaaatgatcggtaaaggaatggatgctaatgaagcattagaaaaagctgcaggacaatacggaagagttgctgacgctgttaaattaatcgatccaagacacgaataatttgtaaggaggaatttaatcatggcattatttgaaagttatgaaagaagaataggacaaatcactccagtattagaaaaatacggaatgaaaacattagaagatgctaaagctgtatgtgatgcatacggaatagatccatatacaatcgttaaagaaactcaaccaatcgcattcgaaaatgctgcttgggcttacgttttaggtgctgcaatcgctataaagaaaggttgcacaaaagctgctgacgctgctgaagctatcggagaagggttacaagctttctgtattccaggatctgttgctgacgatagaaaagttggtttaggacacggaaacttaggggctatgcttttaagagaagaaactaaatgtttcgcattcttagcaggacacgaatctttcgctgctgctgaaggtgctatcaaaatagctgaaaaagctaacaaagtaagaaaagaaccattaagagttatcttaaacggtcttggaaaagatgctgctaagataatttcaagaatcaatggatttacttatgttgaaactaaatttgacttcttcactggtaaattagaagttgttaattcaaaagcttactctaacgggccaagagctaaggttaactgctacggttcaaacgacgttagagaaggtgttgctataatgcatcacgaaggagttgacgtatcaatcactggtaactcaactaaccctacaagattccaacacccagttgctggaacatacaagaaagaatgtatcgaattaggtaagaagtacttctcagttgcatcaggtggtggtactggtagaactcttcacccagataacatggcagctggtccagcttcttatggtatgactgatactatgggaagaatgcactcagatgctcaattcgctggttcttcatcagttcctgctcacgtagaaatgatgggattaatcggtgctggtaacaacccaatggttggtatgacagttgctgttgctgttgctgtagaagagcacgctaaataatatatttataagtatttacttataaaaaagtttagtaaaaaagagtcttatatgaacttattagagtttcatataaggctctttttctgttaaagatagaagaatacgggtattgaagtaggaagtaaaggacaagcaaagagtggattattaaacttatctaattaattaaataaactagctaaaaaagaaaagttaaaaagtgatattgatgaacttaatataataatttacaaattaaataatcttatatattcaagtagaaattataagtatttagtgaatagttttggttcaaataattattattttatgttagtatttcaaaagtttcagtagatagagaaatggtattaatgctcagaaaagctttggaaaaatagaaatgaatttaatagtatatactttaattataagtatatgtgcattatataaggttatgtattattaggataatagaagttaattttatatgatataatatttattatttgatatacgaaaggaaaagaaaatgaatatacagatatttggaacaaaaaaatgtaatgatactaagaaagcagagagattttttaaagaaagaagaattccatatcaatttatagatttaaaagaaaaggctttaagtaaaggtgagcttcaaagcgttaaaaaatcagtaggacttgaaaatttaataaacaaaaattcaaaagactataaaaaattaaatatggataaaataagaggggcggaaacaagagaggatatgttattaaaaaatccaacactttatgtaactcctatagttagaaatggtaaagaagcaacggtaggaaatgctccagaaacatggaaagagtgggaaaaggcaaaatagttactagattagagtagtaataagaaatatactaattatttacaatataaaaagaatagatagatttgctttctatacaaatctatctactctccccactaagtgatttgaatctatgcttatattgtacaaaatctatctattcctactgagtttatgaagtctataacttaaagaaactccatcaagagttttaatattaactaattaaatgctttataaatagcattaattcctttttcaaagtcgtcattttcaattccaactaagacatttatttcacttgagccctgatctatcattctaatattaacatcagcttcagcaagtgcagtaaatattttagaagctacacctttagtataagccatgcctgtgccaacagtagctattaatgccatattaggataaacaactacagagtcgggattacatgcccttttgatttcttcaacaatgacttcagttttattttttaagttagaatcagaaattactacacttacagtatctattcctgaaggcatattttcaaaagaaacaccattttgttctaatatagtaagtatttttctacaaaatcctaactcactattcatcatagatttttcaatagacaaaactgtaaagttttgttttccagcaactccagtaatagtgttttcatgcttggtttcattactaactattaatgtaccatcattttcagggtcattagtatttcttatattaattggaataccagaacttcttacaggaaatacagcttcttcatgaagaacagaagctcccatgtatgatagttctctaagttctccatatgtaatagttttaatctttttaggattattaactattctaggatcagccattaaaaatccaggaacgtcagtccagttttcataaagtttagcatttatgctagcagcaactaatgcaccagttacatcagatccacctcttgaaaaagtaactatatccccatgttgatctgaaccataaaatccaggaataacggccctttcatgggctgaaagtttgtcttttagtaaagaataagtttcctctaggtttaatgaagcatatttattaaatttaataacatccttagcatctataaaatcaattcctaaataattagcaaggattaaaccatttaaatactcacctctactagcagcatagtctacagaagccccattttctatatccttttttataatttctaagtgaggatttaaatcgaaatttaaatttaattcattgacaattgcgtggtatctttcagaaattaatttaaatacatcatctaaggaaatgccggaattaacatgagcatgacatagataaagtaaatcagttaccttaaaatccttagaaaatctttttccaggtgctgaaggaactacatactttctttcagaattaccatcaattatgttttttacttttttaaaatggatagaatctgctagagaacttccaccaaattttgttactatagtattcattgttttgcccccttatattaacaaagttaaaaattaaccttactaattatcttaacaaaaaatgacaaaaaactcaactcgaataaatggaagaaagaaaaatattttccataaaataacacataaattgttattaaaatgacacaaattcatagtataataaagtagtagacttaaaatttagtataagattaaaagaactgcattataagatattatttttaatgcattatttttaatgcattgacttaaatacattcaaagtttatggggagagggaaataaatggacaagtttctggttgacagaatgcaacttacagttgataattacagattagctaaggaagaattaagaaatgatggagatataataaatcactttgcatctttagtttttgcgcattacgaaaaagaaataccagtagagagagttaaagaaataagaaaagatataaagttaaatacaccaagaatatcaccttttagaggagatactttaaatatactttcgttattgatagcaacagttgataaggataaagaagaacagcttattcaagatatgtatgatactatggaaatgttggaggaagagggattcttttcgggctcatatttagcgttatcagcatttactattagtaaatatacgcagttaaaggataaaaaatatataatatcaaaaattaaagagctatttattatattaaaagaaaaatactctaatataactagtgaagatgattatttactttgtacattatgggttataaatgatattcaggcagatactgttgatgattttattgaaaatatatttgatcatatttcagattcaaatattagatctaaaaatggcgtacaaggattagcaaatgcaattatattaaatggatcatcaggagagatgtatagaagtatggaatttatacttcagcttcaaagaagaaatattaaaatagcaaatcaatttttaccattgataggggttttatcaaattataatccaaggagaaatgtagatattgttgaaggtgttatagaatatttatgtgatgaagagggagaatatgaatattatatagataaaggatttagaactattattgctatagttattgtatctttttgttcaatgtcaagtaaaagaagatatattgatgagcttttagctcaaggtatactttcatttattaatagtaagaataaagggatttttgaagaagtactatattaggaggaaaatggataaaataattttgcatgtagatatggatgccttttttgcagctgttgagcaagcagataatccaaaattaaaaggtaaaccggtaatagttggaggagtaagtgaaagaggagttgtttcaacttgctcttacgaagctagaaaatatggggttaggtctgcaatgcccatttttattgctcagaagttatgtcctcatggaatataccttaaagtaagatattatagatataaagaaatatcaaataagatatttactatatttaaagagattactccgcttgttgagccactttcaattgatgaagcatttttagatttaagtgaaagtaagtttaatgacgggttagaagcagctcaatatattaaaaggagagtttttcaagaagtaggattaactttatctataggaatatcatataacaaatttttagcaaagctagcttctgattggaataaaccaaatggaataaagattattacaaaagagatgattccagatgtcttaaaaccattacctgtatctaagatttatggcttaggagagaagtcggtaaaaaaattgaataatatgggaatgtttaaagtagatgacttatatgaattaccaaaagatttttttattgagtattttggaaagtatggaattgacatatatgaaagaataagaggaattgataatagagaagttaaagtaaatcgtgatagaaaatcctacggtagagaaaatacattaaaatttgatacagaaaataaagaagatattttatattatgtaaaaagcttttgtttagaattaagtgaagaattgaaaagaagaaatgtatttattaaaactataacagttaaatataaaacaagcaattttgaaagtcatacaagaagtagaagtttaaattattatacaaatgatttaaatactatatataatgtagcacatgaaatagtaaatgatgaggtgtttgaagagggtataagattgattggagtaacagtatctggagtaaaagaagaaactgttgaacaattaaagttattttaaaattaatgtatactatttgattaaaatttagaaataatatatacgattttagaaaaaaactttccaatctgtagtacatcaattataatatataggggctacttaagaaaaatttcaaaataaatggaggtattataatggataaggcacaaatagctagaatgattgaccacacaatattaaaagcagaagcaactgaaaaggaagttttaaaactttgtaaagaagcagttgagtataattttgcttcagtttgtataaatccatcaatggttcctgttgcagcaactgctttagaaggaactgacgttgaagtttgtactgtaataggtttccctttaggagcaactactacagaagttaaagcctttgaaacaaaagatgttattgaaaagggtgctacagaagtagatatggttataaacgtaggaaaactaaaggaaagagatttagaatacgttaaaaatgatattaaggcagttgttgaagcagctaaaggaaaggcacttactaaggtaataatagaaacttgtcttttaactgatgaggaaaaggttattgcatgtgaattatcaaaagaagctggagctgattttgttaagacatctactggattctcaacaggaggagcaacagcagcagatattaagcttatgagagaaactgttggtgctgatatgggggttaaagcatctggtggagttagaagcagagaagatgctttagaaatgattgaaaatggtgctacaagaataggggcatcagcttcgattgctatatgtgaaggaacaaaatcaaattcaaattattaatataaaattaataaaaaggaagcatatatttgcttcctttttattatatttaaaaatatatcaaaaaaattaaaatttatagcttaaattaattatataagaatattaatataatatatatcattctaaggaaggcgaaactatttaaattaatagtttatggccttagtgggagggttatgaaaagagagttagctccatcagaaataaaattcaatataccattagcagaaagcaaatttgaagaaaatacaaaaggcattaaagagtttgataaagcgtataaaaaaatagaaagggcaataactatagataaagagggatataatctttatttaatagacaccttttcaaaagataaattaaaggatttaacttcctttattgaaaatacgtataaagatttagaagcacctagggatatatgttatgttacattagaagatatcaataagccagaagcaatatttgttgcaaatggtaaagggaataaattaaaggaaacagttgatgagattaaaaattcttatttagaagttgtagatgatttttatggtgattctagcaatgatgaaaaggactatttagttgaagatatacaaaatagaagaaataattatttagatgaattaactaaaatggcaaaagaagaaggatttgaagttaaggcaacaacaaagggatttgcatttataccactaagtggtgatgaagccatgagtgaaaaggaatatgacaatttagaaactgaaaataaaaatgttatagttactaaagcaggtacattaaaaagaaaagcagagactattttagaagaacttaaggatattgaagtaaaatctattaaaaaattaaaaaagatatattctaagtttttagccacacaaatggaagaggaaaaagatgaggctcttttagaattcataacagatgatgattcttatgaatatctagaaagactgtttacatgtattgaagaagatttaattgattgctatacaatgagtatagaagaggatgaaaatcaaatatatgaaattttaaacaaatatgatgtaagagttattgtagataatactaataatagctcaccaccagttatttacgaagaagatcctaatttaaataatttaattggattaatagagtacgaaaatcataacggaatgtatacaacaaatatttcgttgattagtgcaggatctatattgaaggcaaatggaggatgtcttattataagattaaactcactagctgttaataatttaagttattattatttaaagaaaatattaatttctaataaggtttcttttgatactaacaagagttatttagactttattaatattaatggattaaagccacaatcaattccagttaaagtgaaagtaattttaattggtgattatgaaacttatgatattttgtacaactcagatgaagactttaaaaagttatttcctctaagagctgaattttctccagtagttaaagttaatgaagattcaattgctggagtaaagaaaataatagagaagaagcttagaaagaatgaactatttaatcttagtgatgatggtatgaaagaaattttgaaatatttatgtagaaagagtagtagcagaaagagaattcttgcagaagaggatgatattgataaactattagttttatcaaataatcatgctagagaagaaaaaagaatggaaatatcaaaagatgatatacttgcagttgcatatgaacaggaattaatcgaagaagaatttatgagtatgtatgaagataataaaattgttatagaagttgatggaagaaaagttggtgccattaatggattagcggttttagataatggatattgtacatttggtaaaccaatgagaattacttgtgtggcgtataaggggatgggaagaatatttgatatacaaaaggaaagtaatttaagtggtaaaattcatgagaaatcaataagtatattaaaggggttattaacaaatcttttaaatccttatgagaatattcctgtagattttcatttaagttttgaacaaacttatggaatggtagaaggagatagtgcatctgttgcagagattatttctatattatcagccttaagtaaaaaaggaatcaaacaaaatattgcagttactggatcaattaatcagtttggtgatgtccaacctattggtggggtaaacgaaaaaattgaagggtttttcaaagtttgcagtattttagacacatttgaaggtaagggagttttgattccggaggccaataaggatgaactaatattaaaagaagaggtagaagaagcaattattaatggtaaattccatatttacactatgaataatttaaatgatgcaatagaaatgcttcttttatcagacaatgaaggtattgatgatttttatgttaatttacaaacagaaattgataaatataaagagaaagaagatagtaagtagtgtaataataaagtcggttgtaagccgactttattatttggtcagggttttaggagaatgaagtaaatattaaaaaggtaattccataaaaaggtaaaaagccattgactacaaaatgaatattatgttaaaattatggaaaaagaaggaagagatgggaggtataagctctaaatatttatctttagagttaatttttatgtttttgaaatttaataaaattaatgataaactagtagttacacttgttggtgaattagatcatcatagtgctgaagaagttagagttaagatagatgatagaatagaaagagacaatatcaaaaaggttattatggactttaaagaagttacttttatggatagctcaggtattggtgttgttataggaagacttaagaaggtacaaaatagggatggaaaagtatgtataatcaatgtaaataaaagagttgataaggtatttacactttcaggactttataaaataattactgtttataataatgtggatgaagcgcttgagagtatttaatggagggattaaaaatatggaagaaaatagagtatgtatagaatttgaaagtaggtctcaaaatgagggttttgccagagttgctgtatcagcttttgtttctcaattagatccaactatagaagaaatagcagatgttaagacggcggtatcagaggctgtaactaattctattattcatggttatgaaaatgataaaaagggtataattaaaatagaatctacaatttatggaaaagaagtaacgattacggtaaaagattacggaagaggaatagataatattgatcaggcaagggaacccctttatacttcaagaccagaccttgaaagatcaggaatgggatttacagtaatggaaagttttatggatactttagaggttgaaagtgaaaagggaaagggaactaaaattacaatgacaaaaaaatttagttaacatgttaggggagatttatggaaaagggtgaagtaaaaagagaaagagtaagctatgaggaaaattcacagttattacctttagctaaagctggtgatacaaatgccatgaacaagctcatagaagctaatttgcctttggtgacctctataagtaaaaaatttatgaatagaggttatgaatatgaggatatttatcaaattggatgtatggggcttgttaaggctataaaaaactttgatgataaatataatgttaaattttcaacttatgctgttcctatgataattggtgaaataaagagatttattagagatgatggaataataaaggttagtagaaatgtaaaaagtttagctaaaaaacttcattttgataaagaagctttaactaaaaaattaaatagggaccctacaattgaggaattagctgaattctctgaaatgaataaggaagaaatattatttgcattagaatcttctgcaagtatgcaatatctttatgaagtaattcatcaagatgatggttctccagtattgttaattgataagctaagtgaaagtgcagttgaagataaaaatattactgaaaaaattgctttaaaagaagctttaagaagtttagatacgaaatcgagacaaataatagtgcttagatactttaaggataagacacaagtacaggtagcaaagatgttaggtataagtcaagttcaagtttcgaggattgaaaagaaagtattacaagaaatgaaaaaacacttagatgaaggatgaacaaatgaaaatgaataatataaaagtaaataaaatataaaataatctatattaaataataatttatttaatatagattatttttttgtaatttaattttgctttagaggaatactatacatattcaataaaatatacaaggagatattcttatgagtaaaagagcacaaaaagaggaaaaaatattacaagaatttcaaacaatttctaaggagatggctcctaaaccaaagtattttaagaatattattttggcatttatagttggtggcattatttgtactataggacaatttattttaaatatgctattgaagtttggcgtggatgaagaggctgcaaagcaatggttaccaataataatgatatttataggagcattattaaccggatttggggtatatgataaaattgcatcttttgcaggagccggaacagtagtaccaattacaggattttcaaatgcagtagtttctccagcaatagaatttaaaaaagaaggctttgtatttggagttgcagcaaagatgtttacaattgcaggtccagttcttgtctatggtataggaacatcagtaattattggacttatttattatgttcttggtttattaggaattattcaatagggaggtatgtagagttatggctgttaaagataaaaaggtcggaaaacaaacaataaagttagaaaatccgcctaaaattatttcaacttattctatagtaggtccgaaggaaggtgatggacccttaaaagattattttcatgaaataattagtgatgatacattggggaaagatagttttgaaaaggctgaatctgaaatgatgtacacagcaataaaaggcgctataagtgcagctaatttaacagaggaaaaaatagattatttatttgccggtgatttattaaatcaaataacatcatcaagttttgcagcgagagaacttaacataccatttattggattgtatggtgcatgttctacaatgtcagaatcattaagtatggcatcattgtttttagatggtggatttggaagttatattgtagcttcaacatcttcacattttagtgcagctgaaagacaatttagatttcctttagaatatggttgccaaagatgtccaacatgccaatggacagttactggttctggggccatggtattaggaagaagtggagattatcctagagttacttatgttacaacaggattagtaaaggattatggaataaaggatgctaataatatgggagcagcaatggcacctgcggctgtagatactatatataatcattttaaagatacaggtcgaactcctaaagattatgacattattgcaaccggagatttaggtaaagtaggaaaagaaattactactaagctacttgcagagtatggttatgatgttaaggataattatattgattgcggagatatgatttttgatgatgaaaggcaaaagactgactcaggtggaagtggatgtggatgttctgcagttgttacctgcggatatttatataaaaaattaatgagaagagaaataaaaagtgtattattagtttcaactggagcattaatgagtactacatcatctcttcaaggtgagactattccaggaatagcgcatgcagttgctattgaattttaataagaaattggagggaatttataatggactatgttagtgcatttattgttggaggattgatatgtgttgttgctcaaatattaatggatacaacaaaactcactcctgcaaggatattggttatttttgtaacattaggagctattcttggcggatttggaatttatgataagttaattgaaataggaggtgctggagctacaattccattacctagttttggtaattcgttagctgatgctgcaataaagggagttaaagaagatggcttacttggagcattcacaggaggaattaaaggtgcagctggaggaatcactgcatcaatattttttgggtatttaatggctcttatatttaaccctaaaacaaaaaaataacttagattaaatatatacataatgatttaattactaaaatagatgataattattatcaagaataatattaatttctagggtaaaaataatagggtaatgaagataaggaggtgatattatggctaagaatccaagtattaaatgtagtgtgcaacaatgcaaacatcatgattgctcagaaaattattgtacattaaatgcaataacagttggtactcatgaagcaaatccaacagttgttgaatgtacagattgtcaatctttcgtactaaaataagagataaaaagaaggggctgtatcaaaataaattttgataatagccgataaaaaaaggagggttcgaaaaaatggagcgggtagtgggaatcgaacccacctttccagcttggaaggctggagtattaccgatatacgatacccgcgtatcgactacgttgtttagtatattatctttgtcgatgtttgtcaacactattttttcatttttttatattctttttttaatagactaataattatttgcaatgatataatgtaaatgattaactaataaattgagaggattacactatgaaagaaataattatggcaaatggtaatttaaaagcatctgaaattggattagggtgtatgagaattgcagacttaaacaaaagcactgtaaatagtttaattaacacagccttagagtgcggaataaatttttttgatcatgctgatatttatggcaatggaaaatctgaagaaatatttagtgaagccctatctttaacgccttctttaagagaaaaaatgattatacaatcaaaatgctcaattagatctggtatgtatgacttttctaaagaatatattataaattctgtagatggaattttacaaagacttaatactgaatatttagatatattattactacacagacctgatactttaatggagcctgaagaagtaaacgaagccttcgagaagctatataaggaaggtaaagtaagaaactttggtgttagcaatcataattcaatgcaaatagagttattaaataaatacttaactaataaaataactataaatcaacttcaatttagtattatgcacactggaattatcgactctggattaaatgttaatatgaaaaattcacattcaattgatagagatggatcgattttagaatattgccgtttaaaagatataaatattcaagcttggtcaccttatcaatatggattcttcgaaggagttttcatagataatcctaaattcccattgcttaataaaaagcttaatgaattagctgaaaaatacaatgttagtacaacagcaattgctactgcctggattcttagacatccagctaaaatccaaactattgttggaacaactaacgaaaatagattaaaagatatctgtacagcttcaaatgtaactttatctaggcaagaatggtatgaagtttatttagcagctggcaatgaactaccttaatttaaaaattaattttctttatattataagtgtattatctattttaagataatacacttattttttaattattgttaaaatcatttcattttcttaattttaaatatatactataagaatatataaaatttatcattttaattaataacttaaggaggaataatgaaatcaaaaaacaaatcattaatttttattatagttttaactatttttagttctctttcatttaacatggctcatccagttacccctatgttcataaataaactaggattaccaacctttatgtttggactattctttgcaacaatgtctatagggaattttattggttcaccattttggggttctttatctgataaaaggggaaggattaaatttttaatacttggtgcactaggttatggcattagccagcttggatttggttttaatacaaatccctttataatacttatatttaggtttacaggtggtttttttgtagttagttatttaaccacttctatggcttatttaaccgatgtaacaacaaaagaaaatagagttaaatatattacatattactctgctgcaaatacaataggtacagcattaggttctttactaggtggtataatcggcactaataacttcaagtatactttttttacacaatttatactttgttgtattttaagcattttaattttcttccttttagaggaaccacttaaagaaaaaataaatacttctaattccgtaaaacatgaaaagttaaattactctcaattcttaaataaaaacctacttattatgcttatagttgtaataggattttactttgcagcaactagctataattcaagtatcaattattatatagaagacgttctaaaattatctccaacatttataggtggttttattgcatttacgagtgtattaggctttattgcaaacttaacatttactccattacttgcaaaatattttaaagaaataaatatatttaaagctattactatttgtattagcatagctttagcgcttatggttatatcaaaaaatgttatcttattcttaacttgtgcagctatatttacagcctttgctagcatccatataccgctacaacaaagcataattactaaactttctaaaggtaattatggatcacttatgggaatccttaactcttcaaaagctgtaggtcaagtaacgggctccttacttgcaggatttatatttgatttaggaaataaattacctttccttatttcatcaataataattttaatttcatttattattttaattcctttaaatcctaaagccactataaacgaagattaatttgaatataaaaatgctatgtcattttatttatgacatagcatttttatttattattattcacttttaattattatttcatcatcaataccatcaatagtaacatgtgaaccataattaatatctccagcaataattaaccttgcaagtttattctccaaagtattttggatatatctcttaagtggtcttgctccatatactggatcataaccttcaactgctaatatatgcttagctgcaggtgtaatatctaatgatatatttctatcttttaatctattagcaacttcatttacaaagatatcaataatcttagtaattccattttcagataatggcttaaacataataatatcatcaactctatttaagaactctggtttgaatctaatcttcatctcattcattacttgctctctaatttgtggttcaataccatcctcatctttattttcaagtaagtaactacttcctatattagaagtcataattattattgtatttttaaagtctacagtcttacctttattatctgtaagtctaccatcatcaagtatttgtaagaacatattaaatacatcatcatgagctttttctatttcatcaaataatattacactgtaaggttttcttctaacagcttctgttaattgaccaccttcttcatatccaacatatcctggaggcgctccaactaatctagatacagaatgcttctccatatattcagacatatcaatccttataatattttcttctgaatcaaaaagattccttgctaaagtttttgcaagttctgttttaccaactcctgtaggacctaagaaaataaatgaacctattggtctatttatatctttaagacctgcccttgcccttaaaattgatgaagtaacagatttaatagcttcctcttgacctattactcgcttttccatttcagattcaagtcttaataatttttctctttctccttcaagcaagttagatactggaattccagtccatttagataaaacttgggatacttcttcttcagtaacctcttcttttaataatgcaccttcataattttcttttacttctacttccatttgattaatagctgcttcaagacttggaatttcaccatattgaatttctgctgccttattataatcatattgtctttgagctgcttctaaattacctctagcttcatcaagcttaccttttaattcttttaattttaagatagcacctttttctttatcaaacttagctgtcatttcatcatttttagcttttaactctgaatattctttttctaatgcttctaatttctttttagaaccttcatctttttctcttgttaaagcttctttttcaatttctaattgtactattcttcttctaatagcatcaagttctgctggtaatgaatctatttcagttcttatcatagccccagcttcatcaataaggtcaattgccttatctggtaaatatctatcttgaatatatctatcagaaagcttagctgccgcaactatcgcagagtcatgaattctaattccatgatgaatttcaaatctttcttttaatcctcttaaaattgaaattgcatcttcaactgatggttcatcaacaataacaggctgaaatcttctttcaagcgccttatctttttcaatatattgtctatattcatcaaaagttgtggcaccaatacaatgcaattcacctcttgcaagtaaaggcttaattaaattacctgcatccatcgcgccatctgttttccctgctccaacaatagtatgaatttcatctataaataatataattttcccttcactattttgaacttccttcaacacagcctttaatctttcttcaaattcccccctatatttagcccctgctataagagaccccatatctaatgaaaaaataattttatcttttaaaccttccggtacatctcctcttactattctttcagccaatccttctactatagcagttttacctactccaggttcaccaattagaactggattatttttagttcttcttgaaagaattctaatagttcttcttatttcttcatctcttcctattacaggatctaatttatgctttttagcaagctctactaagttagttccatacttggcaagtgcatcataagttccttccggatcttgcgtatcaaccctttgacttcctctaacttcagataaaaccttcatgaaattatctttatttatattgtatttatttaaaatttgtttagaaggtccatttttatcaacatccattattgctaatattaagtgttctacactaatataagaatctccaaactttttagctaaatcatctgcctttacaagtacttcatcaacttgccttgttatataaactccagaactatttgctccttctcccataacttttggcattttatctaaagcattttttatatcaactttcattaatttaatattgattcccattttagtgaaaatattggggattaatccatcatcggcctccactaacgcagcaaataaatgaattacatcaatttgttgatgactatattttactgctattaaatttgcatcatttagtgcttgttgtactcttaatgtcattctttcaacattcatttataatcacctcttattagtattcttaactttaatttaattttaatacaaaagtcaaagaaagtcaaagtaaattttttttatttttttaacatttttttactgtattaattatagcttatttttaacttattatactttatttatatttatttttttgtttttattggaacttattgttataatagttacagaattaatttacacgaaatttgaggtggaacttttgagaagagaatatataaactatccttttgatttaccaataaaaatctcctacttaaatataaaaaactatccaactcattggcataattcaattgaaatcatatatgttttgaaaggctcattacatataaaaatagatactgattcctttgtacttaatgagaaagaagtcgaaattataaattcagatgaatctcatgaaataaaaagcaccgatgataataaggttttaatttttaatatagatccatatttcttcggtaaatattacaaggatataaataatgtatttttttatactaattctaatgctaacgaaaagcaaaatggcgaagaatatgatgagttgaaaacacttctttcagaaacactttgtgaatatgtacaaaaacttgaagattatgatgaagaaattgaagaactattaataaaattgctttatcatcttattaataattttcattatctaacacatgaaaaagaggaacttaaagaaaagacagaacaattagataggtatcatagaatatctaaatatatatttaataactataataataatataaccttacaagaaattgcaaagaaagaatttttaagtccgcattatctttctcacgagataaaatatgcaacaggttatagctttacagatttaattaacttaacaagaatagaagaatctattaagttattattagatagtgatatgagtatatcagaaatttcagatgaaataggattttcacatgttcgttattataataaaaattttaaggcttattatggctgcacacctcttcaatatagaaaaaaaaatgcaactaccgaaaaacaatatgaagcctctaaacaatatacagagcttccattagctgaagctttagagtcattatcatattctttagataattatagcagatttaactttgaaaataagctatggaatattcacgtagatatggataaagttattaaacctttagaaaagaactttaaagagtgtattaatttaggtgaatcatttgatttacttatagaagataataaggatatattagaagaaattcaagaagaaatacattttgagtatggtaggttggaaaaaatgttccatagtgatatgggagtattcttagattcagatttttataactggaataaggctaaaggtgttttagactttttatcaacaatttatcttaagccattaattttacttgataaccttgaatactctttagaaaaatataaaaatatattaagtagctttattgattattttaatgaattagatatcgttgatataaatgaatttaaatttcaatttgattcccgtttatcaccttctattaaagaaaacctaagagaatttataactattaactatgaactagatgtatctactacagattttttatctagttcacatttaaattctatatatgatacagcatatatgttgccttatattattcataatactcttttcaagagtaactcactaaactttttaaaggcatttgacgttttagaaaaagaaattaatattactaacgaggtatttattggagctcccggaatagtaaatgacatgggaattagaaaaccttcatactatgcttattatctttttagcaaacttggtagtgacataatctcattagctgatggctatatagtaactaaatctgatgactattacgcaattttattatattcacataatgatgatgttaattccttagcaaactatgaagatatttatcaaaaaggtggagtgaaaaaatcctttgaaagaaaatattcacttaatatagttaatattaaaacttcttcaaggataataacttatgaagtaaatgaaacaacaggttcttcatataattactggctttctatggggtctcctgataggcttagtaaagaagagaaggaaatacttcataaagcttcctatcctaagatagagtttaaatattcaaaaaaaagttcagttttaaatgttataacagaattaaaaggctatggcgctaaactaattgtactcaaaaacactaaataatgtactaaaaacaccttttttaggtgtttttatgcttttaattaaattttcttttttctcatttagcacttattgtacaaaatctaaagcattaccgtgaatacaatatttttttatttgctatatactaataatataaagtttaaagcaaaggggcgttttttatgagaggactattttttaatccatcattactaaataacactaaagcaaagtggtcattttggatttggatgtcaaaccttttacatcatgacaactaaataattattatgagctctataaatttaatatataaaaacaagaagtagagaaatatttctctacttcttgcttttttatatttttttttctaactgtattgctaaagtaaaatattttatcgagtcttttaactcattcaagttataatataaatctgccatttcattatatcttatatatctttcttcattattagcaaatcttaataaaaaatctgttgctaaattcatatacatttctgcttgaatatattcatgtcttttttgatgtatcatacctttaaagtaatatgctttttctattaacttttcgtcatttatattaattgctaaatctaacgcctcatcagtatatttaaatgcttcatcaaattgcttatttttatataaagttgatatagattttattaaaaaatctccacatccatgtttttcagttctaggatatattttaatagcttctcttatttcatccatagccctatctacttgataaaccttgaagtaaatttcaccatttttttctttaaaacttgcaaattcaattgaatcactctttttgtattgaagtgccatatttaaatatttttcagcctcaactttatataataaaatattaacaatcgcaaattcgtgataataatcacctttatctttatctgttttaaattcgtctgtataatctattactttctttaggcagtcatatgctttctctatcaaattgatattcttataacaaattccctcataaaaacacgcataaacatatttatcattataaggtaatttttctttttcaaaaacttctcttattcttgaataataacttattgcttcatgatattcacatgttttcataaagaatcctgccatatcattataataagtaataatatcttgattattctttgaactttgatatagttcataataccttgatattaataactgtattctctcaagtttattattttctatatataacttgaacaaagtatgagttaattctaatgctaaatcagtataattatatctacatgaatattctagattatatccaatcatttcatctaacttatctaaagaataattacttttattaatagtatctatatttaatttaatttgctcataaacatcttgagttaaataattataatcaatctgtaacttttcagcaatatacttaagtgattctttatctgctttaatttttccattttcaatacagctcattttagaaatagaaatcctatccctacataattcctttagagtaatacctttatacactcttgctctttttattttttctcctgttgataatatctccatggctacccccagtttagttatttagtattcctaagtttctaaatattttaactccctcgtctaggtatttagctgcttcatagtcttttttaattcctatgtagtatctgcctaaaagtatagctaattctgctgcctttttatctaatccatttactttagctaaattaaatgtttctaataatataacttctgactcatcagccatttctttaatagtatatactctataccataataaattttgttctattatttgttcaacattagttccatctattaatgtttttatttcatctaataccctttcacatttattaatttctttgattttaatatatccttcacaaatatttattaatgtttctattacattaatatcattatttctcatacgtatttcttttgcaacattatagtgtctaaatgcttcttctatattatcaaactcaaagaataatttccccaaattattttcaattgctgaaatattcttttcttcttctaactctttgtatacctctaatgtcttttttgagtattttatagcatttattaaatcaccttttttattatattcttgagataacaacagtaatgcttttccgtattcttcacgatgttgaacttgttcaaatttttgcttagctaaaaacgtataatctatggctttttttatattatctattttaaaatagctctctgccatttcataatagatctcgcctaatagggaatcatttccaatgttattatctaaatatactttttcggcttgttttaaataactaattgctgagtgatatgcctttagacttaaagttatttttcctaaatttaaaaatgtatttataacttgttcaaaattattttgcttaataaatattacatttgcagataaatataattgttgagccaataccaattcattctttgctttatatatgttcgcccttaaaaataaattttttgcttttctatactctaaatcgtacttttctgtatagtataatgcgttttctatgtatttttcagcacttatatagtcctgattcaaaatgtatgtttctgccatttgttcataatatacacatatcttttctgcctgagtttcttctgactccatcaaatattctattgatgtctgtagagtattagctaaatactctaataaatccattgacggatttgatcttcctgactcaactaaactaatttgtcctggtgtaattctgtctcctgctaagtccttaagtgtcatttgcaactcttttcttcgcctctttatcttttcacctaaagtaagtatctccatagctttttcttcctttacccacatttatatttattatacatttatttataattatattataacataaaaaaaaccaaaaaaatatattttttgacttttaatttcaattatatttaaaataattctaaaaaaactgttatagaattctataacagttttaacatctttttattaataaatataatctaaaatattatcgcatgcatctcctgcagcacccataatttttctacttgttttttttatgtttctttgagtctttttatctaactctggtaaaatcatcattcccattgctactccaaaaacagttcctatcgctaaacttttaattatttttcccaaaaaaaacacctctctttttattttctaaaagtagtatgtgtattttcattataaaataatcattttttaaaatacctatatactcaaattcgtcaaataagtacatatttccttaataatagagtgcttatattatccctaatgcttctttagctaatttatctgctaaatcattatatttatgtccactatgaccttttatttttttaaatttaacctttatttctttcatcttattttgcatatattcattatactctgatgttatcttattatttcttttccaagttcctaatgcccaagattcaacgccctgatagtcatatgctattgttacctccttgaaattattttcaagtgcaaattcaacagccatttttgctccaagaacttctcctgatacattccttaaagaaattgcttctttatcgaaaccttgccccttatcttcatgaataatttcaccatcattcacagctactaaaccataagaaaagtttcctttatcaacagcaaaactaccatcaacataaataaataaccctttttcatcttctatgccttcagcatcatctttacaagatgtttttccttgagaatttatagaaataaaattcactgcctcctgctctgtcggaaaacttttgtatattgctcccttaaatcctattacttcctttttacattcatcccatgaagtaaaaattttaggtgctcctgatttacctctataaacagcataatacttcaagtttaatcatcctttcttatttatataacactttcttaaaattatgtcctatagttatttttttatattttcatttaaaataaaatatttaatttaaactgataaaacctcttccataactctataaatactatcaatattttttgcccctgtaaaattagttgcataatcaataacgttttttaatactattaatatgtcatttttaccttgccaattttctaatactacatttaatggtacatctgtcattataatatttaatgcaaaaactcctattgcaacatcatctatttttcctataaaaggtaccttatctggaataatatcgcatggcactgcaatatatgctacagctgctgaaataactagctttgttttcatacttactcttttatctttaagtaatctatatattaatgctgcaatatctggcaatacaaatatatagtcactatacttctttgcattgttaggcaacttatcttttatcttatcccttcctttagtatacgaatcttcggttttacttatatcctcctcattaaactctgatgctttttccttttcaaagtttaacaattcgatttctttctttaattctcctcctaaagagaatttagcatttctaagttcaacattaaaaactccataggcacaataaatactatatatatcaaaatccacatatggtatatcttttaataaatacttatattgaataataacttttcctttatcataattaattcccacttcagttaatgattttaatgcaaattttaatattgtttttcttataaatgaaggtattcctatatttaatactttaaatccagttaactccccattaatcaagccattttccatagaatttaacttcaccttcaactcaaaatttattgtaagcccttttgtaaaagatcctaaaattcttatatcctcttttacctcaatattattaattttaatttctttaatagctacaaaatcattgtatatacttattaaatcttctccagtcaatcctacatttatacttgaaactttcatagcttgtctcctttctaactaaacgctttaaacacgtactattattccaataatatttttctatatttacacataatatacagtatactttatttgtttatatttttaaagcttgtctttatattgttaatattaaaaatatcatttaaaatcttttctagtctataaaagggacttacaaaattaattgcaaatcccttttctatatttaagcccctgtataataactaattccccaaataattattatagttttatttattgcttttatatgattaaaatactggaacaactgcacccttgtatttctcttctataaattctctaacttcatcagaagttaaagcttctgttaaatcttttatcttttgagtgttttcattaccttctttaacagccaaaacatttcttctttcttttaagctttcaacatctttatcttcagcataaaatgcatcattattaacatcaagccctgcttctaaagcatagttaccattaattacagctatatcaacatcttgtaaaactcttggtaaagttgctgcttctaattctttaaactctaattttttaggatttgaagtaatatctgctgtagttattaactccccatcattaacctcaattaatcctgctgcagctaaaacccttaaagctcttgcttcatttgatggatcatctggaactgctactactgcaccttcctcaacttcgtctactgtcttatatttatttgagaaagctcccattggttctaaatgaatttctgctgtataagttaaatgagttccattatctgcattaaatgaatttaagtaagctatatgctgaaaatagtttgcatctatttcccctgattctaatgatgtatttggtaatacataatcagtaaattcaactatttctactgtatatccttttgcttctaaaagtggttttgcaacttccataatttcttcatgaggaactggtgaaacccctatcttaattactttatcatcaccatttgaagaactatcattagatgatcctgcactattaccacacccaattaatccaattgataatacccctgctattattgctgttaaaatacttctttttttcatttttaattccccctaaatttattataaatatactatcaacttaattttttatataaatagttccctaaactttgaagtccttgaaccattattattaaaataacaactgtaacaatcattacatttgtttgatatctttgatacccatagcttatcgctacctttcctaatcctcctgctccaacactacctgccattgcagaatatcctattatattaataatagttaatgttaaacctgaaattattgctggcactgcttccttaagcattaccttaaaaattatttgaaaatttgaagctccaaatgatttagccgcttcaattactcctggatcaacttctttaagagctgattctattattcttgcaacaaatggtgctgccgctattgttaagggaactatcgctgcagtttcaccaattggtgttcctacaatagcccttgttaatggaataataaaaactattaatattataaatggaaaacttctaagtacatttattactacatctaaaaacttgtatataatgatatttggccttaatccagttggggatgtaacagttactactactcctaatataaagcctaaaacacttgcaaataacgttgagaaaaataccatataaatagtttgtccaagtgcttcaattataatgtttatcattttactatccattttataacacctccaatataatatctttatctgatagatatttcattacttcttctctatctttctcatctatgtttatagttaaagtacctaagactttttccctaaacttctctagctttccacctactatagaaaagtcaatattaagttctcttgccatttttgttataagtgcattttctgatgaatcacttgggaagaataatttaatattaaccccttctcttggtaatgtatcatcatctaactcccctaaaaatgtctttaatgaaacttctggtcttaggaatacttcttcagctttaccctctgcaacaagaattcctccttgaagtaatgcaaccttttggcatatttgcttaacaacttccatttgatgtgtaaccaccactatagtaattcctaattttttatttatatcctctaatagtgaaagtatatccttcgttgtttttggatctaatgctgaagtagcttcatcacacaatagtatctttggctctaatgctagtgctcttgctattgcaactctttgtttttgtccaccacttaattctgccggcttacttttagccttttctgcaagtcctactatttcaagaagctcattaacccttttatttataaatgccttatcatatccccatacttctaagggtaatgatacgttttgaaatacattttttctgtttaaaagattaaatccttgaaatatcattcccaactcttttcttaattttcttttaccttttccacttaaaagtttaacctctttgtccataactttaactgaaccttcgttgtaatcctctaaagcatttatacatcttaaaagagttgattttccggctccactatgtcctataagcccataaatttcaccttcatttatatttaaagaaatatcttttaatacctcagtttttccaaagttttttttcacattctgcattttaatcatagtcgtccacctccatattgataaacaattaattttagataacaaaaaacgcactagagaataaactcaagtgcgtataaaaatcaccactaatttactctctcatcattcagtcataaaactgcaggaattagcaccaacgttaataattttttgtttataattaatagttagtaattatttataaaattctactgaatttctaaaaaataaaaacatttcttattttaactatcaactgttaacttttaacaggttgccgggtttcacagggccagtccctccaccactctggataagattcaaatatttaattgttttgctttgttgatattaatatatattagtttgtctattttgtcaataatttctttggtaaattttttcacaagctttaaacttttccaaaacttaatataacctctaaattaatatctttttcataaataccactaatatcctcaactccaatatcccaatcaccatgaccagcatctatacatactataaaatttttttcatttaacactgcaatatttacttctttagatattttgatttccttatttttttatattaacatttaataaaattattaacattaatataatagctcctattcctaaacttatcatcttatatctatatattctttttaattcattttttattttccccatttaattaacctctaacttaactataaatatttatgttaattataaatgagtaagcttaatttaaacttaaaaatgtgtaaattcaccatatttacacatttttacacttattttttataaagtttaaaactcagtaatatcttcctctattcttataagctctgcatcagtattatcttcaacaaaatctaatattttttcttttactgaatataaaatatccttagatgtagctactgaagaaattcctataactatattttgatgaacatcctgcatttctacttctgatactgaaacattaaatttattagaaagtctcttagttaaacttaatacaatcatccttttttcttttaatgaatgtacccattcagctcttaactctaacttcatcaataatattttcatattataaatcctccaatctaatttttataatatacattcaacttataagataaatagtttaaatatatttactatatattattatagtataccaaaaaggcaatgaattctcctattattcattgccttttaataaaattttactattactttatcctataatactaatttatttttaattaattctattgaatttcctttaatattgtccttcattatccatccaacttctaattctaacttatccatacttgtatcatttaatttgaaatatgatttcacataaaaatcatcatctctttcatcctgatctatacaagatgttccaacttcactaaataaatatatagacgtatgaaaacacacttttgtttaatcactaaaaaatatttttaattacctttctaaaaaaacaaattaattaaataatttgttagaatacttatctgtagttcaatctctttgcctatgttaggtaattttgatgattcacacactttatcacatctataaattttctttattattctataccacttatactttcaattaaatttataaactcaccttcatcttttttatctagaaatatatctatcaaagtcttagtaggcattttaacatatccttttttcccattgataaaaatatctgttagtttctctctaaaatcattttcattataattcaactcatttattaattcacttacttcacatttagctaatgtatctattaatttttctcttattgcttcattaaaattttctgcaaacactctttcctcttcgcttagctctgatgtatcattatttaacaaactaaaaatgttcataatctcttcactccgttattttatttaattatgttttaataggaattcgcacaaaaatatttatcttatatctaaattcatttcttttacataaattgctcttttagatatggctccatacactaccgttaatttttgcccgctactaatatatggataatctctaacataaagaatatactctcttttcttttcataatcagttatataaattgcataataaattctagaacttttgctttcagatttttcaactatatctgtacatataccacaaatagatgtttgtacaagaattattaattccaatataaaagctataggtctaatggtaagaagtaaaaatattattccatcgatagatctatttgaaaatacagaagcaactataattatactaacaatgtcaaaaagcttaattgctgataatctttctgaaaactttactttttcataaggattaatccatattttccatctccaccacacgctactttcttgcttttttaatacatgttcatgttctctctttacatatctaagtctttcagcatacatatttcttgttattaagtatatagctaataaatatacctctatattaaacgctgccatcattactattttatccctaaccacaataagaacgattatcaaatagataatatttaaataattcatataacttaattttttatttataaaatcagatacttcttcagtagcttctaccttaatattagtcaaaattaaaaatcctacaaataataataaaaatgttcctatattaatgaagtctgtttcattaagaataatacttactccaaaaataaataaccaattggtattaaaaaaattgttctttaagtgttccatcctctaaaacttcactacctattactgcaaacattatagaacatataatactaatacaataatatttggagtaatattaaataaagatatcttcaatttaaataaataaaatattaaaaatattattatttctaatattaaagctattaaccatgttttttttaatactttttacccttacttttcatattttttaatcctcttcatcacttctatactctaaaatatctcctggctgacaatctaaagccttacagatagcatctaaagtagaaaacctaattgcctttgctttattatttttaagtatagaaagattcgccatagttattcctactttttcagaaagctctgttgcactcatctttctttttgccatcataacatctaaatttacaataatcattaagttttttctccttatatagttaagtcattttcttcttttaattctattccctttactataagttctctaattaccgatgtaatcataaaaatcatcaaagtagcaatagtaactacaataaataccaaattatggtacataaatataactgctactatataaataaaaaattctattaatgaataaatacttattttctttagcctttttaaggttgctttatttaaatatgtatcattaagtaaacttttagataatttcattacttcaattagtaaaagtaaaaatggaataattgtaataaataaaaatgtattaatatactttggaatttccatattagtgaaactaatgtaataccactttgttaacccctgtatacacatccatccaacaacagtaatacaaatagctataactgacattatgtataatacttttctaaatgtacttttttcaaacttaatcacctcattgctattttatatgatttttttatagttagtcaataattatttattgtttttcaataaataatcattaattatagaaaagaaaagaggctacacttgtagccccttatttattaaacatttattttactcttaattatcttttcttgtatttcatctttatgactttttgtttgccttgatatattaagtaacacccctacagcagctaagttaaatacaagtgatgtacctccataacttataaatggtaaaggcacccctgtaactggcatacttcctgtaacaactgctatattaattattacctgtactgctattacagaaataatacctgttgccaaaagctttccatatttatcttttgccttcatagcaacatcaataccagcgataattaacacagcaaaaattgccataattataacgcatccaactaaacctaattcttctgctattattgcaaatataaagtcattatgtggttctggcatatataatgccttttgcttagaatttccaagaccaacaccaaataatccacctgatcctattgcataaagtgaatgaactaattgatatccttcatcattagcatatttccatggatttgtaaaactcataaatctttctcgtctataatcagtgctaaaaatcccaatggcacctaaaaccccacctactcccattaatgtaattgtttcttttccattcattcctgatacaaaaaccataataaatgcaacaaacattattatagatgcaatacttaaattattttccatataaactaatatagaaaatattcctgcagtgcctaaatatattaatggaactatccaattctttttcacctgaccatatttttcaatcatcattgctaagaaaaatacaattatatattttgccagctcagatggctggaaagatacacccgctatattaagccaacgtgttgcaccattaatactatctccaaatattaatactgcaactaatgctaaaagtgttatcccatatcctaatacagtgaactttttccacacatgataatcaattaacatcattgctatcattgctataataccaataggggcccatgttaactccttacctaagaaatagaaaacatccttatgcttatataaagcatcataataacttgctgaaaaaaccataattattccaatcgctactaaagccataacagaacaaagtatatataaattaacagctttatatcttcgctttcgttttacaggtccttttttcttcacatttcccttttttatatttttcccattacttttcatattaccttccccagaatatacttattaatattcaaactctttcttaagcgttatagtaacctttgttcccttaactactttattaccagctgcaacactttgtgaataaacattcccttctccctcaaattcataaaccaatcccaaattatctaaaacagaaatagcaaattcctctgtgtttccttttaaatctggcattattacttccttatcaatttgactactatcctttgccgttattgtaatagtagttccttctttaactgttgctcctggataaatatccatagaaactatagtcttaccatttcccttaacttcagcttctaaattatttgcttttaatatttctttagcttcttctatagattttcctcttacatcaggtataattacgttcttataaattgagaatctttctttagcaagtggagaatccatatacttaaatacttcttcaaataactctttcattaatggtgctgcaacttccccaccataataagctccattacttggttcatctactgcaataaatactgttatttgtggattttctactggagctaatgctatcattgatgaaatgtacttatcttttgagtaagttccagtttctggatcaaccttttgagctgtccccgtttttccaccaacattatatccttgaacaaaagaaccatctggtccatcttttgttacagttctttctaaataacttcttaataaagctgtactttcatctgataatacatctttctttataattggtttaatttcttcatctataattctatttccactttcatcttcatgtgaaatttccttaactatatgtggttgtattaaatcaccaccatttgcaattgcattaaatgatgtcataagttgtaatgatgtcactgtattagtttgtccaaatgaaattgttgctaagtcaatagctgatacagtatcgcttgatttaactataccagatgcttcccctggcaaatcaattcctgttgtttttccaaaccctaatttataaatatattcatttaatttttctattccaagcctttgtccaatttccatcataccaacattacatgaattttttaatacttcagctaaagtttgagtgccatgaccttcatgtttccaacaatgaacagttgtatttccaaatttaactgacccattacaaacaaatgtatcatcatcacttactaatccttcttctaatgccgctaccattgtaactgtcttaaaagtagatcctggttcaaaagtatcacttactaaccaatttctccacatattttgaatttgatcattttcagtctcaccctcaaaagtctcatatccttcataaggagtattaggatcatagtcaggtttatttaccattgcaagaatttctccattattaggatccattattaaaacatgaactccctttgcattatgttcttctaaacctttttgagcaattttctcagcaacatattgtaagttttcatctatagttaatataatatcatttccatctacaggaggtgtaaatttatatgtttcaaatggtaatctatttccccaactgtcatagcctccaattttcattcctgaaattcccgctaaatattcatcatactgtaactctattcctgttaacccaacaccttctgaattaattccccccaatgcagttgataaaaagtttccatttggataatatcgcttaacgtctcttgatacaatcaagccatatatccccaaatcatctgcactatctgcaacatcttttgtaattcctcctacaagtcttgcatatgttgcatcactaccatcactattttttttatttaatgcttctaatattttatcataacttacatccgataccacagaagctatttgacttgcaatttcttccttagttacatctttattttttatatgagttctaatggcatccaaatcaaaatcaagtctataaacattagcagaagatactaataccgattgatttctatctaaaatatcacctctagtcgctgtcacactaatttctctttgccactccgaatttgccttagcttccaacgatctaccacttactaacgttaaccatcctaatctaataactaataaacctaacaagcaaaatacaatagaataaactaacttcaatctctgcttatagcctaatgattttttatcttttttcttctttttctttttgtttaccattcctctatctcccatcatagatttaacatatattccatttatgttacataactattattctactacattttgctttatatcaaaagatactaatattaatattatattttttccgtggaaattttatataaaattcataataaaaaccccctgtaaacactgttacagagggttttattacaaaatatacactttatttgctattatatttttctttgtcaatcttattaaagctttttccaacagcaactgctgtaaccattgttccattaacatttaacatagtacgtcccatatctaatacaggatcaattgctattattcctcctgctaatgggaaatatgctcccattcccattcctgaaattgctaccgaaacagccattgttgcacttcctggtaatccagctatacctaaagatccaattacaattatcactataagcattccatagaagctaatatccattttagttcctgacatattagctaatgtaactgccattaatgcaggataaattgctgcacatccattcatccccatattagagcctaaacttccaacaaatgaagaaattccattatcaacaccaatcttatcagttagtgtttcaatagtaactggtaaagtaccaagactagaacgtgaagtaaaagctaaaattagaggttccattgccttctttacataagtaataggatttaatcctaatatagctataattattaaatgaattataaatactataataatacttacataaagtgcaactatgaatccaacaacttcttttattgcagctaatcctcttcctgctattgtatttgcaagcaatgcaactacagcatatggcataaacttaataacagtcatagctagactagtaataatcttatatgaagcattaactaaatcagttacaggcttaatgacatcactgtactttttatttaatatcttcattgaattaccgataaatgctgcaaatattacaacagcaactacattaccttcagccattgctgcaacaggatttgatggaagtaatccccttaatgtatcaacaactggagttatttctcttatttcacttgtactttcaactatacttgaagaaaccccaagcttaaataaatttcctactataattcctactatagcagcaattgcagtcgtacctagtaatgttaagattgatcttgttgttaattttcctagattttcgccagccttcatatttataataactctgatgatagatacaaatattaaaggaactacaagcatctttaataaatccataaatccataaccaataagaccataccacttgtttacttcattaatccactgaacttctcctggattacttggtaatcctgctactaattgaattattacacctaaaattaatcctgcgatagttgaaattatcattcttgttgaaaatttaactttcttcttagccataaaatttacaccaaacaatatagctacaagtatagcaataaatgctatggttttaaaatttgttatcattataaattccgataaaaaagtattgttcatttccgccctcctatatgtctataaataccaatatatatattacatgaaaatcatatattatactagtttaaattatatataatatacaatttcttgttcttcttttctatatttattaacaatttcctctaatgttattgattcaaaatagtcatttatttttttatttatttcactccaaactgttctatttacaaattcttccacatcacttgattcaccctcttttacatctatcagaagcagctcaccctctaaagaccttaaaacttctcctattgtgatttcacttggatttttagataaagtatatccaccttgcgcccctttttttccaactattagccctgactttctaagtaatgaaaatacttgctctaaatatctctctgatatattttgacgttctgatatagctttcaatgttacagaaccatattctgaattgattactaaatcaatcaacgcaattatgccatatcttcctttagttgaaatcttcataaaatcaccttctttgtaatattttaaggattacccattattcctatcggtaatacgctaatactatatctttttcactaaaatgtcaatatatttatattattgataataaaagtaaaaaatataggatagttagaaataataaactaactatcctatattaattacctcacgttattccattatcgattatctattttattaatcttaataactcattagggttctgaataatataatttgcaccggcacttactaattcttcttctcctctgaatccccatgctacacctactgatttaacattagcattttttgcagtaatcatatcaacatcggaatctccaacatatatgcattcctctttactaacttttaaatactcaattacttcatatacagttcttggatctggtttgacagcatgatttactctctgtccataggtaatttcaaatttctctccaaaatattttttaactacttctccagcaaactcatctggcttatttgatacaacagcaagctttatattgtttttccttaatccatctatcatgtcatcaataccctcatatggtttcgtagtatctagcatatgatctccataatactcatcaaaaagagctaaaactttatttatcactacttcattctctctatatatttctggcaatatacgttgaattaaaacatatcttccacttccaacaaacttcacatactcatttatagcatgttcctcatatccacagcttcttaatgcataattacaagcattagctaaatcctctaatgtatctaataacgttccatctaaatcaaaaattacagctttaatcatttcacttctccttattgccattgaattttatattatcatttgtttttttatattaaatagtactaatattattatatcatagttttataatacattattatcaaacagcttttcatttaatcattatattaatgcagcaattttattttttatatttaatccattattacactccccataaatgtaatttatcattaacaatttaacttgatatcttgttatactaatatattttttcatatagagagatgttatatcaaaatgttgttaacaacattttgatataacatctctctatactcttaagtatataacattatactttctctcattaaaaatatctaaatgcaattctatatgtatcaatattcccccaagtaaatatattttaattattagcattgcaaataagctattctctaaataaaaaatagcttatcactaaaaaagaatctaaattttcacatcatattgctatagtcttatttttaatattttcccatgatatatatgtattaatttctgcttttacattaatttgagaatatattctttttattgaaaatatatttcttctttcatattttatattatttttatattcaaaagccctccaacttaaataataatctaagtacttacttgctactccattaaatttaataagccatttcctcaccttatttgaatatgctaaatctattttcaactcattattaccctcatttaatgttacgcccctaatctcatttaaagcattagcaaaagtctttaatctactatcctgaaaaccaacaacatatgctttagtatctattctaggtataatattatttcttaattcactaaaccctaaaaactttctaccagccactattggacttatatctattgaatcatttatcgcattaacaactataattttatctctctcttctccatgatatcttctatcccctttaaagttttcatataaaactaacttagttaattcaacataagatcctatttttttaatgtaatttttttcacacaaatctgctaaaaacctatgtctccaaaaaaatgctgtcactaacgtaatcttcattttagcagcacattcccttaatgatattcctttaataaaaagttcaaaatattgtttccagttttctttgaactttttagaacatctaaagggattatttttatcatcaataaatgttttacaacaaccttcattcttgcatttatatctttgaattccattataaaatccaaatttaatatttttttcactatgacacttaggacatttaaccttactattatatttatcatctttgtttaaatcaaaattactgctacactcttcacacttttcatcctttgctatgctattaactaaagttctatacatattaatcataatacatcaccagttatgattattaacttatatatataatttaaaacatcaattaatcacattcgtgaatttttacttaaatttgatttatatttttaatattaaaataatataaaagctaatgccttcatatttatataaaaacattagctctttatttcattaatataatgtcttaattttaatttaatccatctatctttatcaattaaactttttaataactcataaaagatctatttctttaattcagtaaaatttactaaacattatcaatattttttctttcacctttaaaattattaatcttatttcttctaattgttaattgttcatttaattgttctaaagttatttctttatctgccataagcaccagtacatgatatgctaaatcacaaatttcgtttactatctcatttttatcttcacctttagcagcaattatcacctcagtgcattcttccccaacttttttcaatattttatctgtgcctttttcaaataaatatttagtgtatgaaccctcttctccattttcttttctatctttaataatttcaaatatatcttctaataccatatttaacacaccctcctaaagaaacaactctttttaccagtatgacatgctgctccactttgaatcaccttaattaataatgtatcattatcacagtctgtccaaatctctttaacctcttgaaaatgtcctgaagtagctcctttattccatagctcatttctactcctgctataaaaccacgtctttttactttctaaagtaagtctaagactttcttctgacatataagcaaccatcaatacttcattactttcataatcttgaataacagtaggtatcaatccatttcctttttcaaagtctaaaattatttttttcatttcaaacctcccattaatcatttatctttatattaataaattatattattaaattctcactgcaacatttctttgtcttaaatattcttttacttctctaacacttaattcaccgtaatggaataatgaagctgctaatgcagcatctgccattccatcttcaaatacctcttcaaaatcttttaatgtcccacaaccaccagaagcaatcactggaacattagtaagttcactaacctttctagtgagctctatatcaaaacctttcttagttccatctgcatccattgaagttaataatatttcaccagctcctaatctagcgccttcttctatccatctaagtgcatctatgccggtatcaattcttccaccattaacaaaaacattccagccactattatcagctctcttttttgcatctacagctaaaacaatacattgatttccaaaataataagctccttcttttattaactccttatttcttacagctgcagaatttaaacttaccttatcagcaccagctcttaatattctctttatatcactaatatttcttaatcccccacctacagtaaatggaataaaaatcttttcggagactctttcaactactttttccattatccctctaccttcatgagttgcagtaatatctaaaaaaacaagttcatcagcaccttgtttataataatattccccaagatcaacaggatctccaacttcttttattcctacaaagtttatccccttaacaacttttccagctcttacgtctaaacagggtactattctttttgtatgcataccttcaccttcaatccttttaggaatttgttttacataaatcaatagcttcttttaaatttatgtatcctgaatatattgctttcccaacaatcacaccatatatattcaaatttttaagttctttaatatcatcaattccagctactccccctgaggctgttaaattgatttctatatttttacctaactttttaagcatatctatatttgtaccttttaaagttccatccttactaatatcagttaaaataatatttttgacacctaactcttccatctttttagaaaaactaatataatgaagcttgctttcttcaatccagcctcttccacatagatattcatttttacaatctactccaactgcaattttttctccaaattcattaacaactcttttaacaaattcggaatcctcaattgcaaccgtacctaaaattaccctacttactccattatctattagatatttaacatcttgataagttctaattcctccaccaacttctactggtacatttacttcattaacaaccttaataattatttctttattaactaattcacctttttttgctccatctaaatcaactaaatgaatatagcttgcccccgcattttcaaagccctttgatatttctaatatatcttctcctacaatttccttcttatcatagtcaccttgataaagcctcactggtttaccatctataatatctatggctggaattataatcatacaatcaactccccaaaattattaagtattttcaatccaacttctccgcttttttctggatgaaattgtgctccatatatattttttttattcaccattccaggtatgttaattccaccatactctgaatatgcaactaaattatctgctagcatatttgttgccatgaaactatgaacataataaacaaagctttcatcattaagaccattaaatatttcactttttttattaatttctaatctattccatcctatatgaggtattttcacttcttcatttggctccattagcttaactgtaccatttataaatccaagcccctttctatgctctccttcatagccttcttcaaaaagcatttgcatacctaaacaaatacctagtaatggacacccatcattaacctttttatttattataggaattaaattcattttctctaaattatccattgcatccttaaaagctccaactcccggcaatattaatttatttgctttttctatatcttttatttccccggaaatacgacaattaaatccaagttttattaaagcattatatacactctttaaatttcccattccataatcaataattataatcatacatcctcctacaattctttaaaatctttaaagaatacccttagaagaaggtatgctattaccctcaatagtaatagcttcctttaatgctcttccaaaagctttgaaaatcccttcaattttatgatgatcattttccccatataagacctttatgtgtaatgtaattccggcattaaatgcaactgctctaaaaaattccttaaccatttccgtagaaaaatcacctatattttctcttttaaattctccttcaaaatgtaaataacttctcccactaatatctaatgataccattactagtgattcatccataggaagaaagaaagttccatatctttttattcctctcctttctcctaatgcttcatttatacattttcctaaagctattccaacatcttcaactaaatgatgatcacaaacatcaatatcaccatctgcatttaaattaatacttatattgctgtgaaatgccaataaattaatcatatgattaaaaaatccgatatttgtttttacactgctttttccgtctccatctaaagaaatttctaaagctatatttgtttcattgctttttctattaatttgagacactctcttcatacttctccctcacacaacaacacattacattttctataatgtttacgataaaatcattttctaaaggcgaacccactgaaattctaaagctatcatcatcaaaatatcttattaatacccctttgtcctctagcgctttttttaatttttctttactttttgttctaccaaaaataaagttggcctttgatttataaaacttaatttcatcattgctattctcttctattccctttaaatatttatataatctttctctttcatacactatttcttcaacattttttaatatcttttccggatgttttaacacaacacatcccactagttgagaaaatgtatttaaattgtatggaaccttatctgtagttaagcttttaatcaattccttatttgcaattaagaatcctattcttaatgccgctaatccccaagctttagataatgttcttgtaataattaaatttctatacttttctataaatccaatcatactttgtccataaaattcataataagcctcatccacaactactaaagtatctttaaatgattctaaaataaaaataatatcctctgtacttattacatgacctgttggattgttaggattagaaaaaataataacttgcggctctactttcttaccatatgctataaatttattaactgagaactcaccatctttttctgtattatactttttaattatcccatcatttaaagaagtataaaaatcatacattgaaaaatctggattaatagttagcacagtcttccttttagttatttgagtatctattattaaagcaatcatctcatctgacccattaccagcaataatattttctttacttactccaattacatttgcatatgcttttcttatatctatagaatcattatcaggatatctattaaagtttacttttttcaattcattaataacctcattcaattcatcttttgtaatatttttataactttcattaccatttgctcttataccaatttcatcattcattatccctttatagcttttaattttcttcatcttctaaccttacctttacggaatttgcatgagcagttaaaccttcttcatttgcaaactttattatcttattcccatccctatataatgcacgctttgaataagataagaatgatgattttttcacgaaggtatcaactgataacggtgatgaaaattttgctgttccactagtaggcaatacatgatttgtaccaccaaaatagtctcctattggttctggtgtatatgctcctaagaaaacagatcctgcattttttatttcatctaagtaatctaaaggattttcaagtaaaatttctaaatgttctggtgcaattaaatttgataactttatacattcatcaatatccttacacacaattatttttccataatcccttaaagatttttctattatttcttttcttgatagatttttaatttgaataccaatttcatttttaacatctaaagccaactttttagatgttgttaataaaatagaggatgctaattcatcatgttctgcttgtgacatcatatccgcagcaatatatcttgcatttgcaccattttcagcaataactaaaatctcactaggtccagcaaccatatctataccaacaactccgtaaacctgcctctttgcttctgctacatatgcatttcctggcccaactatcatgtctactggattaatactttctgttccataagctaatgccgcaatggcttgtactcctccaattttataaattttattaacaccacaaattttagcagctactaatatattgggattaatttcaccattactattaggtggcgttacaattataatttctttaacccctgcaacctttgccggaattacattcattaatactgatgaaggatatgctgcttttccccctgggacgtatacgcctgtactttcaactggaattattctttgccccataaaaattcccaattccttttgataaagatagcctgtctttttttgcttttcatgatacttagtaatattatccttactttcttctaatatttctaatatagacttatcacatttattgtaagcactattgacttcctcttcagaaactaaaaaatcccttaaatctactttatcaaattttaatgtatattctcttaatgccttgtctccattttctttaatatctttaataatatcttcaacattttttcttacatcagctgtgttatttctcttttttaaattttttacaatttcatttatactcttattacttaattctactatgtctatcatattaaatttgccccctttatttttatataacaaacactattaattacatactgctcttattttatctataaaactatttatttcatttctttttaatttaaaactagatttatttactataactcttgagctaatatcacaaatttcatctacaacaactagcccattttccttcagtgttgtacctgtttccattatgtctacaataccttcactaattccaagtataggtgcaagttctacagatccttctatttttataatttcaacatccattcctttgcccgcaaaatacttttttgctacctctggatactttgttcctatttttatatgccctattctattaaaaatattagcatctggtaatgttgctacaataaatttacattttcccatacctaaatctaatacttcatagtaattttcttctttttccaataatgtgtccttacctactattgcaatatctgctactccatgttctacatatgtaacagtatcgttagctttaactaaaaaatatctcacatcatttttggtgtcattaaaaactaaccttcttcccttatcttttaattcttcaactccaaatcctgctttctctaatagcttaattgcttctttttctatcctaccttttgtaagtgctatactaatcaactcacccacacccttttaattctatttataaattatttctaccttttcaccattcctagttttatttatgactttctttaattcttctaaataattatcttcatttaaaataactttttcacctttaactttttcttcataatcacaagaatcaataagcagatttacatctactgaaaatcctattgcaggaatgcttttaccgaagttatctaataaattatcgtatcttccacctctaataactgttgaacctatttcttttacatatcccttaaatattattcccgaatagtagttaactcttggcaccatactaatatccacagatatatacttctcatatccaagcatttgtaaatttaaatataaattttcaagatactctatattttttttaatatcttcattaaatgctaactctttagcttttttaatcatttcataatcaccaaaaagccaagggaatttatttaaaaattccttatactcttctttaatttctatatcatctaaatattcttttaaacttgttaaactctttttattaattaattcaataaccttgttttgattatcaatagataaattcatatcttttaatgctgattttaatatgtttacattacctacttctaacttaaattcttttttagtatctaatgccttcaatacttctaaggctgttactaatacctctaagtcagttttttctcctgatgccccaatcaattctattccacaatctaaatattcatttctttttccttcaaaactctcatgaactctaaaaacctcagcactataaaaaagttttaatggtaactccatttcttttagtttggtattaactaatcttgcaacaggcaccgtcatatcaggtctcaatactaaaatccttcctctattatcgaagaacttgtacatttcttcttcttttaaatcttgagttttatgattgaaggtttcatagtattcaactgttggtgtagacacttcactatatccccagcttttaaaactttcagtaatagtttctataatcttatttctccttttgcactcatcaatagtaaaatctctcattccttctggtataatatttttgatttaaatctccccctttagcacgttaaagtattaaagttattattattattagtaataataccccttttggttttatttgtcaattattattttaccatacatttttatatatttttggtaaaatttcatttttatctttttataaatattaatttgttttaatcattagtaattgttttatattttattaatttttacataacaaaaaattagttacttaaaatgtaattagccttttaaactattttatagcactatcaatttcttcaaccattgtcattgtagatataaatccacctgttgctatatagcaaatagttagatctaaataaacaatatttcaatttttatacacattcattttccattaatttctttttcggttactttagtatttaattcttcaattgcttctttaaaggaaacctagcaaagctaactaactctttaattgttaatctaatatttatattattttattgtcttaatatagttattttttgctaattctttgttatcccaagttagataacctaccttgctatatttactaattgaatattattacaatttagttaaagcatattaattaaggtatctgttatatagaaatattttttttggaaccattacctacttttttatagattattaaatgcttttttacacatcataatagtgtaaagtaaatgattactttataaataaatatttaaaaggaggaactttataatggcacaaaaattagttccagaagcaaaaaatggtttatcaaagttcaaaaatgaagtagcaagtgaaatgggagttcctttcactgactacaatggtaatcttacttcaaaacaatgcggaagcgttggtggagaaatggttaaaagaatggtagaacaatacgaaaaaggaatctaaaaaaataaataaacttattaattacaaaaaagagtttatataataagtcttctgaaaatgaagttatattatatagactctttttattaatttttataaaatttacaatttaatcattatttattgttaaatttttaactattttatctctatattatttattttttacattttgttaataattccttcaatattatgcataacacctccacttcttccctttgattataatgtaatactatgatattataatttatgtactatttcgctataatttttgtagtaattttttttatttctatcttgaaaatttgaaaaattagtgatatagtttaaataggccattgttaaataataattgttattaataaacaataattattattaacaaatatgataatactgttgatataattttaaataattagaaaagaggcgctatgatgaaagaacaatggaatgatttcaaaacaggttcatggacaaaaagtattgacgtaagaaactttattcaaactaactacactgcatatgaaggtgatgatagcttcttagctggagctactgaagctacaactaagctttgggctgaagttagtgaattattcaaaaaagaaagagaaaatggtggagtattagacgtagatacagaaactgtatctggaattaatgaatacaaccctggttatattgaccaagctttcgaaaaaattgttggtgtacaaactgacgctccattaaagagagcagttatgccatacggcggtatcagaatggctgaaaatgctgctaaagcttatgggtacgaagtaagcccaaaaatttctgaaatatttactaaatatagaaaaactcataaccaaggagttttcgatgcttatacttcagaaatgagattagctagaaaatctggtgttatcactggtcttccagatgcttatggtagaggaagaatcataggtgactacagaagagttgctttatacggtgttgatagattaatcgaagataaaaatgctcaaaaattatctttagaagttaaaactatagatgaagatgtaatcagattaagagaagaaatctctgatcaaattgttgcattaaacgaattaaaaggactagctgctacttacggatttgatatatcacaaccagctactaacgctaaagaagctatccaatggttatactttggattcttaggagctatcaaagaccaaaacggtgctgcgatgtctttaggaagaacttctacattcttagatatctatatcgaaagagatttaagaaatggtgttataactgaagaagaagctcaagaattaatggaccacttcgtaatgaagttaagattagttaaattcttaagaactccagaatacaacgatttattctcaggagatccaacttgggttactgaatcaatcggtggtatgggattagatggtagaactttagtaactaagaactcattcagaatacttaacacattatatactttaggaccatcaccagaaccaaacttaactgttttatggtcaactagattacctcaaggatttaaagatttctgttctaaggtttctattgatacatcatcagttcaatacgaaaatgatgatttaatgactccatactggggagatgactacgctatcgcttgttgtgtatctgcaatgagagttggtaagcaaatgcaattcttcggtgctagagttaacttagctaaaactttactttacgctataaacggtggtaaagatgaaaagtacggaatgcaagttggacctaagactgctccattaactggtgaatacttagattacaacgaagttatggaaagattcgatgttatgactgattggttagctaacctttatgttaatacattaaatgttatacactacatgcatgacaaatattcatatgaaaaattacaaatggctttacatgacagagacgtattcagaactatggcttgtggtatagctggtttatcagtttgtgctgactctatttctgcaatcaaatacgctaaagttaagccaataagaaatgaagaaggaatagctgtagatttcgaagttgaaggtgatttccctaaattcggaaacgacgatgacagagttgatgaaattgctgcatggttagttgaaagcatgatgaataagatcagacaaaacaagacttacagaaatgcttaccacactcaatcagtattaacaatcacttcaaacgttgtttacggtaagaagactggtactactccatgtggaagaaaagctggagaaccattcgcaccaggagctaacccaatgcacggaagagactgtagcggatcattagcatcattaaactcagttgctaaacttccttacgaacattcacaagatggtgtttctaatacattctcaatcgttccagatgcattaggaaaaacacctgaaaacagaatccacaacttaggtactatgatggatggatacttctctcaaggtgctcaacacttaaacgtaaatgtatttaatagagaaactttattagatgctatggatcacccagaagaatatccacaattaactatcagagtttctggatatgctgttaacttcattaaattaacaagagaacaacaattagacgttataaacagaacattccacaaatcaatgtaatttgtttataatattaaacagagcttattgcatatgcaataagctcttattttttaaattaaatcaacaattaccaaatctggcctattgaatagtctcaatggaaatccactattacctagccctctactaactactaatttatttctttctccatatactcctttataatactttggtaaaatcccttgacctggtgcaaataatccccctataaatggtagtataaattgccctccatgggcatgacctgaaaacataatatcaaaattatatttgttatatgaatattctcctacagctttaaagttttcaggataatgtgataaaacaagcttagttccatccttcttttctaactcttcaaatagctctttataattatcatagtaatatttgctatttattttattataaaacatttcaccgtcatcttgtcttctttctaccaagcctaatatatgcaccttatttctatttaaatataattctttaatttcattatttaatacaataatctttccattatcaagcttttccaatatttcttcaattttttcagttctcatttcattatttcctggtatatatactactggaataattttatttagctctactaaaaaagctattattttatccatatttttcaaacttgaatctatcatatctcctgttgcaaatataatatcaggttttttattaattataacttttcttaacctattattattctttccaaactctttactatgtaaatctgaaagatgtattattcttattttttcatttacattacactttatacttatatttgttgtatcaaaaacattattttcataatagcaaaacattattattataaatactaatattacaattatctccattacttctctcctttagcaatataatataactattatagtctatataattataagatactaataataaaaagcaactttttattattaatatttaataaatattaatttaaagttcaaaattgaaacttttattatcattaattagaagtattaaaataatacttctttctattcatattttactaattagttttatttaatttcctcctaaaaaaaataggaatgaaacactcttgtctcattcccatttaatataactataattattcttgttcagctaatttttttaattctgcatatttttgtctagcatgttcttctgtcatttggaataattcttccgcttgttctgggaactgcttagcaattgcagagtatcttacttgatccattatgaagtctctaaagcttccttgtggctctttagaatctaagataaatggattctttccttgttcctttaattctggattaaatctgtataaatgccagtatccagccttaactgcttcatccatgtttcttatagagaatcccattcccttctttaatccatgactgatacaagttgagtaagcaataatgattgatggtccattatgtgcttctgcttcaagcattgctttaactacttggttcttatcagcaccaatagctacttgtgcaacataaacatttccataagacatcatcattcttcctaagtctttcttcttagtcttcttacctgaagctgctaattttgccatagctgcagcaggagttgatttagaagattgtccaccagtgttagagtaaatttctgtatcaaatactaatacatttacatcttgtcctgatgctaatacatgatctaatccaccgtatccgatatcataagcccaaccgtctcctccaaggatccattgtgatctcttaactaggaaatcagctctttctttaatttcttcaactaatacttttgcttctttattttcaatgttattttcagctaaaatagcttcaacttctcttgaatgaacttttgaaagttctccgttatctttattttctaaccaattcttgaatacttctttatattcttcagctatatccatagaaattaagctttccatatttgaagctattttctttctcatttgatcagctgctaagaacataccatatccaaactcagcattatcttcaaataatgagttagcccaagctggtcccttaccttcatggttcttagtatatggtgttgaaggtgctgaacccccccatattgatgaacatccagttgcattagcaatcatcattctatcaccgaataattgtgttgctaatttaatatatgcagtttcaccacaaccagcacatgctcctgagaactcgataagtggttgcttgaattgactatccttaactgttttacctgtagttaagtgttctttgtttgatacttcttttgatactgagaattcccagtttgcaacttctgtttctacttgagtaccaagtggtttcatttctaatgccttacctggtgctggacaaatatcaacacagttattacatccagtacaatctaatgtacttacttgaattctgtagtttaatccagctaatgttttaccagtagctttcttagtttcaaatccagctggcgcttttgctaattcttcatcatttactagaactggtctaatacatgcatgtggacaaacgaaagcacattgattacattgaatacattttgacatattccactctggaacctctgtagcaacacctcttttttcgtatgctgcagttcctgctgggaatgtaccatcttctaatccattaaacgcacttactggtaatttatctccctctaaagcattcattggattcattatattcttaacgaaatccgttacttctttagtttctactttagcttcttcactagcagtcttccagctttctggtacatttattttaactaatgaattcataccagcttcaacagcttcgtagttcatgttaactactttgtcacccttcttaccgtaagccttcttaattgaagcttttaagtattcagtagcttcttcttcaggtataatttctgctaatttaaagaatgcagattgcattatcatattaattcttctacctaatcctatttcagaagcgatcttagttgcattaactgtgtagaagtttatttcattttcagctatgtatttcttcatcttagctggtaattttctttcaatttcttcttcgctccaaattgtatttaatacgaagtttccaccctttttaagtccctttaataaatcatattgatttacataagcttgtacgtgacatgctatgtaatctgcttcatcaataaggtaagttgatcttattggtgtatctccaaatcttaagtgagacatagttaccccaccagatttctttgagtcatatgcaaaataagcttgtacgtatttatctgtattttcaccgataatttttatagcttgcttattagctccaactgtaccatctgatcctaatccccagaacttacatctaactgttcctggtgttgctattcttaattcttcttctaccggaattgaagtgaaagtaacatcatcttcaatacctactgtaaagaagttcttagaattttctttctttaagttatcaaatatagctttgatatcagatggtgttacatctttagaagctaatccataacgtccaccaactatcttaggtgcattttcttttccatagaatgcagaacatacatctaggtataatggttcaccattacatcctggttcttttgttctatcaattacacaaatcttttctactgattgtggtataacctttaataaatgttctactgagaatggtctgaataagtgaactttaactaatccatacttttcccctctagcatttaattcatctatagtttcttctatagcttcagttactgaacccatagcaacaattatctctttagcatcttctgcaccgtagtaattgaataatccatagcttcttcctgtcttttcttccattttagccatatattcttcaactattggaattatatcgttatagaatttattagaagcttctcttgtttggaagtaaatatctgagttttgagctgttcctcttgtaacagggttgtttggagttaatgctctatttctaaactcttttaaagcttctctatctaacatttctgcataatcttcataatctaaaacttcaactttttgaatttcatgagatgttctaaatccatcaaagaagtttacgaaaggtaatcttccttttatagctgcaagatgagatactggagctaagtcagcaacttcttgtactgatccagctgcaagcataacacatcctgtcattcttgctgccataacatcttgatgatccccaaatattgataatgcttgagatgctattgctctagcacttacatggaatacacctggtaataattctcctgctaccttgtacatgtttggtaacataagtaataaaccttgtgatgcagtaaaagtagttgttaatgcaccagcttgaagtgaaccgtggaacgcaccagcagctcctgcttctgattgcatttctacaacattaactgtttgtccaaaaatatttttcctcccttgagcagaccattcatcaacaacctctgccattgtagtagatggagttatagggaatattgcggctacatctgtaaacgcatatgctacgtgagcagcagctgtattaccatcaatagtcatcattttctttgccatgataatataccttctttcattatcctaaaagttttttaaataataattgttatttaataataattattatacttcatttttattttttttctagtacttttcctagaaatatttttagtataattttgtaatcttttgtcacttattagtataataagatatttctatttcttcaatagaaaaataccatctttatacatttaatttttaaataacaattaaaagattttctaatcattttatattgaattattaaaatccaactaaattaaattagatattttaactattcataatattactctttatgtctatattctacaagaaggcactttttttatatatagtatcaaaaaagatactaagtatatagttttacccctttatttatgttattatttataattgtacgaataaaggaggttttatcatgaataaaatacttacttttcataatgattgcagacttaataatcgttgtgctaaatatcaaacatgcccaatggtacttgttcataaaatattatctggaaagtggaaaattttaatcttatggtatttaagtaatgataatttaagatttagcgaattaaagcgtaaattaccagatacaactcaaaaaatgctaactaatcaattaagaagtttagaagaagacaatcttatatttagaaaagtctatcctgttgttccacctaaagtagaatatgggcttactgatatcggcaaaaaaataattcctcttcttgaatctatgtattcatatggagttgaatactctaatactagaaattaaaaaaactagctaacaagcaattatagttgagttagctagttttttttacttgtaatctattaagattttattgcaaatactaaaataaatttattaaaacactatacttgtcctcgtttatttattgacaataattattgatagattataattattattatagaccatatagtatttaataataaataaaaaaggagatttttacatgtctaatacattcaaaataactcaagacctattttgggtgggagcacttgacccaaacctaagaatttttgacataataatggaaactaaatttggaacatcttacaactcttatcttttacagggctctgatggaattgcattgtttgaaactgtaaaagaaaaattctttgatgaacacttagataaaattcgctctattgtgaatttagaagatataaattatgttgttgttaatcatacagaacctgatcatgctggatcagttgaaaaaatacttgaatatgctcctaatgcaactgtagttggaagtactttagctattaaatatttaagtgaaattattaataaacctttcaaaagtaagatagttaaagatggggaaacattatctttaggtaataaaactttaaaattcattagtgctcctcaattacattggcctgatacaatgtacacatatgtaattgaagatgaaacattaattacttgtgattcttttggtgctcattattgtgatgaacgtattttaaaaagttcaattgaagatagtaaagaagatgactatatagaagcttataattattatttcagaatgattatgggaccttttaaaccttttatgattaaagcaatggataaaatcaaagatttaaatttaaaatatatttgtcctggacatggattagtattagatgatactaatattgaaaagtttataaatctttatagagaatggtgtcaaccaacaaaaagagagaaacaaagtatagtaataccttatgttactgcctacggatatactgaaaaaattgctaaggaaataaaaagaggtattgaagcttcaagctttgatgttgatattttaatgtacaacttagttacggcagacatgaatgaagtattaaatgaaatcaatcaatgcagcggtttattactaggttctcctacattattatgtgatactttaccacaaatatggactattttatcttcattaaatccagtcattcataagggattaccagcaagttgctttggatcatatggttggagtggagaagctcttaaaaatattaatgaaagatataaacaacttaaatttaacgtagtatgtgaaccactaggtatactatttaaacctagcgaagaaaacttaaaggctgcttatgattttggattagaattcgctaataaagttttaaaataaaaaataaggctgatgttaagtatcagccttattttttattattttcttttaaatagtttacttaaatccataatcaatgctgaaattatcgcaaaacataagcaaattcccaattgtaatcccccaaaactatccggtatatcaaaaatacctcttactcccggaattaatacaacactatataagcacaaacatactattattgcacctataacatatttgtttttaaatagtcctatcttaagaaccggttcataatttgatctggcaggtaatgtctgaaaaatccttgcaagtgttacagttgaaaacgccattgcttctcctaacattggagatgttaaatttccaacatattgtgctagtataacaaaaactcctattatcattcctcttattataacagcttgccatgttccaccagctaatattccttcattaacatcccttggcttttccttcattatattaggctcagccatttctaaccctaatgcaattgcaggcaaagaatcatttatcaaatttataaataataattgtaatgcagaaaatggatttgaccaatttacaaatacagcaaataaaatagcaattattgcacctaaatttcctgcaaataaatatgtaattgcttttttgatattactataaactgttctaccaatttcaactgctgatacaatacttgcaaaattatcatctgttaaaatcatggctgatgcatcctttgctacatctgttccactacccattcctatacctatatcagcttgttttaatgctggagcatcattaactccatcaccagtcatggcagtaatataccccttttcttgccaagcctttactatacgtattttattttctggtgatactcttgcataaactgtaatatgttcaagtttttctttaagttccacatctgataaatcatctaattcttttcctgttaaagaaatatcatcttctcccattattcctatttctcttgctatagcagaagctgttgttttatgatctcctgtaatcattactgtttttattccagcaccagttgcctccctaacagcatcataaacctgttctcttggagggtctatcatagctgtaagtccaactagagtcatttctgtttcatcttctaagcaaggaacgaaattttcatccggaacatctttaactgcaaatgctaatactcttaatgccttatttgaaaagtcttcatttacctttctatattgatttttaatttcttcagtcattttttctaattcaccattattaagaacagtattagagcgtgaaaaaacaacatctggagctccttttgtaaacataattgaatttccgttaatagaattaacagtagacattaattttctatcagagtcaaatggtatttcacttaatctatcatatttttctcgtaactctttataatcaattcctctcttttctgcaaaccttaataatgctatttctgttggatctccaatttcctttccagtctctgttatttccgaatcattgcaaagtgtagatgacaaatccatagcctcaacttggcttgaattattatttttttctcctactttagctttatttactccatacataaaaaagtcaacaactgtcattttattttgcgttaatgtccctgtcttatctgtacaaataacacttgtagatcctagtgtctctacagctggtaactttcttattattgcttgttttttagccatatcttttgttccaacagctaacacaattgtaactattgatgataaagcctctggaattgcagcaacagcaacagcaatagcaaacataaatgaattaaatattagatttttcatattttcaccatctatatatcctctaattacttggataataaaaatagctgctgctaaaatcataattattatacctagcttttttccaaaatcatctaatttttcttgaagtggtgtttgtttattacctgcactttctaataatgttgcaacttttcctacctcagtattcatccctgttgctgtaacaactaaagtacctctcccatatactaccgtagcgccactaaagaccatatttctttgatctccaataccaacctcttcctcaatcttatcgctatgctttaaaactgcctctgcttctcctgtaagcattccttctacaacctttagactttgtgcttctattaatcttccatctgcaggtatgtaatctccagcttctaaaaatactatatcacctataacaatttctcttaccggtattgtctttttcttgccatctcttaatacttttgcattaggtgaagatagtttttttaagctatctaaggagctttcagcttttcgagtttgtgtgacccctaataaagcatttaaaattactactacaaatatgataaaagattctacaaattcacctaaaaaaatttgtactattgcagcaataagtaatattattactaatggatctttaaaattttctaaaaacattttccatataggaaccttgtttccttcctttaattcattaaatccattcttttcaagccttatctttgcttcttgatcagatattccatttatattactacttacttcatttaatacatctgaatattcctttttataatgcatttaaaactccttcccttctcttttgtactaatattagtatttacttaatttaacgattatattatttaagacttccagatcttattattgaaatcaataaccataaacctaagatacctgaaccaaaatatccaattaatccaataatcgaaattccatataaacgtggtgctggatttatattaatgatcaaggacgatcctactatcattccggcaattaccagagcaaaggataatctattcaccattttatttaatacatctatatatttatctttatcttcaattactatgttaacctttgttcttcctcttattaaagtatccgctaaagaaattaaacgcgatggaatatttaaactatccctagttaatttatatccttttaataaataatcattaacatcaaattgctcaaaaaaataatttttataataccccttaacatatggtattactaaattaataatatttaattcaggggaaagctcagcaactaatccttctaccataaccattgttctaataagcatagtgaaatcactagataatcttaggttatttcttttagctatatcggacatttcttgaaacaatacagatatctttatattttttaatgaagtagtataataatttctaaacatgtattcaatatccttataaagtaactctctatccgttttaccattcttaatacctatattcataacaaaatcagtaagtttatctatatcttcgtttgccactgctgtaatagccaaatttaattcctcttgcttttctttagataatattcctacaattccaaaatcaataaaacatattttaccttcacgaattaatatattacctggatgtggatccccatgaaaaaatccatctttcaatacttgcttaaaatatgaaagagttagtttttttgcaatatcatctctatcatagcctaaactctcaatcgcttctttatcatttactttaaatccttcaatattttcttgagtcaaaatattttgacctgtataatcataaataataaaaggagcataaatacaagcactatccttatttaattctcgaaacttctcaatattttcagcttcataaataaaattcaattctctttcagttgatgctttaatttctaaaaaaatttctttaggattaaccactgtatccttaaaaaattttgtaaacttttcactaagtccaattaagatatctaaatccatattcatagtttcttttatattaggtctctgtattttaataacaacatcttcaccgcttttaagtacacctctgtatacttgagctattgaagcagatgctattggtgttttatctatataaagaaattcctcttcaatatttttattaaattcattgtaaaatacctttgccatatttacaaaatcatcagctggtacattatcttgtaatttagatagttctactatatattcttccggtattagttcttgccttgtacttaatatttgacctatttttataaaagttggccctaattcttcaaatgcctttctaagatttgaaggggattttttttctttttcttcttttttgcctaataaatatcctaatccatagtttgtgaatacttttaatatttctttaaatctattaactgaactcccctccataattacctcccattatctaacaattttactttttctcatcacttaacatactttcaagcttatatacccttgcctttaacatttcgaattcgtctctagttacataattacatacttctatattcatatctttaattgtagttgataattgattcttttcctcatgcttacacttatcattaaatgttctttttaactcttctccaagttccttgccctcttcaactgttattttccctttgcttactaattcctcaacaacttctgctgctttatcataagtgctggcaacagctccaactccaaacagtaataccttctttatttcatccatcatttttatatacctcccaagtttcatttatatttatatttatatttatgtattttaatttaaaatatattctaaaaataaaagttagcatatatttgctaactttctttttctttaacacttatttttccctgcacgctagaagcattacttttaacaaatgtacccttagcttcttcattcttaaaatataaatttccttttatcttagtattatcaatttcaaatcctttagcttcaatataaacatcgcctataaaagttccaccttttatcacggtattttcactttgtatagttaagctaggagcctctaaaacataattattaattacattattattgtcatctttactatataagttcaattttcttccaacgcttataacattattttcctctgttgtgtctgtctttaaaaattcgccttcgataataagctcattatttgaagtaatattatcagtaattgttacactataatcattagttaatgcatttattaattcttcttcagtattaacaaattcagtatttttaaattcagtattttcattacttacttcattattttcctttatcctagtagagtcacaaccaaccattaaaatacataaaatggggagtgcatatattataacttttcttttcattataattatcctccaagattatttaagataataccaccaattgaatcctttgatatttatttttcctatctactatttaattattcttattttataaaaaaataaaatgagtataaatattatatatctactaattgatatatactctaatacttatactcatacattataattatttgctatatctacttcttcttattccatatctaaaaccaactctaaaagcagctttcattgcatctctagctcctttttcataaccatctttataaccttcatcataagcatcttcttttcctttattagtaactctactattatcttcttctgaactatgaacgttatcttcatccaaattttctaaatcaatcttttctgaaagaacttcttcagagttaccttcaaactcatctacatcgttataattttcttcattattatctatatccaaatcattaattataacattgtcatactcatctgtaatgtaatcttcttgtattaatttctcttcttgtattagcttatcatcatcttcagcttctataaaattttcatatgattcttctaaattattgtgattttttgaagcttctatgtccataatcatatctccttagaatatatcttatactctattatatgaaaataactttataaggtgtttattttacgtagtgcataatccattgccccatctaaattactactattttttccccctccttgagctagaaaatcacttccgcctcctcttccatctattaatgtaattgtatcttttaacaatgcattcattgataaacctttaatatttttcgaacatgcaaaaatcaaattaaccttatcttcaaattttattgcaaatagtaccaccatattatcatctaatgttatcttttctgcaatttttgttatatattttaaatctccatcattataaattcttttgactacattaatattattaagcttaatggcattttctttcatttctttaatttgataatcaccaatttcaagctttatttttctattttcatcattaatatcttttaattcatttgataatttatttattgcatgtattgcatcttcatcaccacaatttaaaaacctacatattttatttctaaattcatcttttctaaaatagtcttctacagctctttttccagctaaatattcaattcttgttgcacccttatgcttttcccaacgcctaatttttattatttgaagatctaatgttttactaggatgaacaccacaacaagcattaatatctaattcaccaatttttacaattctaatttgctcatctgtattaggcaaatcacgtctaagctttaacttttttaattccttttttgaaggtgttaaaaactctacttcaatattttcttgaataatttcatttgccattatctctgcttttcgtatagattcctcatctaaaaagccttgaatatctacagtacttatttcctttccaacatgaacacttactgtattggcattaaacaaattaaaaaagcatcctgaaagtacatgttgtcctaaatgctgttgcattccatctaatcttctattccaatctattttgcactttactttatgtatcttaattggctttgtttctgcaacatgatgtattaatccatccttctcaaaaacatcaattactttatgattttctatgtagcctaagtcacaatgctgacctcctcccccagggaaaaatgcagttttatctaaaattacatgaaacataccatcagactcttttatatcaagtatttctgctgtaaattcctttaaatattgatctttataatataacttatccattaaaatacctccaaccatttcctaaatattattttataaattttatattactttatctcataattcaacttattttctattctatcttttcttctatttttttccataaatatatgctataatatatttaaatttactattatgttatttattttattataatatctcataaattacatattaatgcagtaaatttgacatatataaaattctatagtaatgtaacgtcaagaataacaattcttataggaggtgcatttattgtttaaaaagttaattactttaaccattgctacagcattattaacatcttcattaagttttgtctcggtgcatgctgctacaccacaagatacgataaatgaaagcttagaaaaatatcaaactcttgataatcaaattttagaattaaattctaaaattgaaggcttagatgttgagatcgataaaactacaatacaattaaatgaaaataatgcagctattgcagacattgaagatgaaataaaaacaacagaagctaaattagaacaaacgaaagaagatataaatgaggcacaagttgtattagataatagagtaagaaatatgtataaaacaaatatgacttctaatattttagttagtataattacttctaaaagtatatctgatttattttctaaggtacaagctatatcaacaatagtttctactgacaaacaaatactctctaatataaatgaaaagaaagtagagttggatcttacaattcaaacattaaatacaaaaaactcagagttagttttattaaagaacactattgaagaagatttaaaaaatatcgaagataaaaaggccgaacaagaacaatatgttgaacaattaaattctgaaaaggaagcagttttttcagttatagaagaaaatgaaaaattattaatatcaaagccattatctattgctaactcttcttctgcttctgcctctgaattacaaaatgctatcgatacattaaactcatacattccattattaaatagttcaacaactattaatatggctaaagaaggaataagtaatgctcaatcaaggattgctgagcttaatactccatcaataccaacaacaggtactaatgttggtaatgcaattaagacattaactatggaatccactgcatattatggacatggcattacagcttctggtttaaaaccagttagaaatcctgacggtataagtactattgctgttgatccaggtgtaataccacttggctctaaggtttatgtttcaggctatggacttgctattgcagctgataccggaggtgctattcaaggtaatattattgatgtatatcttaatagttacgaagaatgtatggcatggggaagaagggaagttactgtacaaattttagaatacccttgattagtttatagtttatatggaaactcctttcggagtttcttttaaatttagaaattcagcctaagctgaatttcttccttaactcttaatatccgcattcctcattaagtaataatacaaaaatcctatttggtactggttttcttattactgtatattctctacaaattctctctggactattacaattcatacattttccaattgctgcacaaggagttttcttatttaatctctttgtattcgctggtgctgcaagattttcaactcttgaaattgcttcatcaatattttttactattttatttacacctgcaataactattaccttatctggtccatataacattgcagcaactctattaccattaccatcaacattatataattccccttcttctgttattgcatttgtacttgtaaaataagcatcacaaaaaaatgcattcctatatatttgttttatttcctctggtgtcaatccttccttatatctgtctaagaattcatatcttccacttcttaaatggtttataacttttgtttcaaataatgtcatagaaccaccaaccgtaactttactattttcttgaactaattcttctattttatttatcaattcgccttgggtattaattaaaaaactctccatattattttttttcaatgcttctattgttctgtttattttcatttcattaacccattttatattattatccatttttatctttccccttcgcaattaatttatatattatatattgaagtaatacttattttaatccaataaatattataattcttttttctacttatgtatgatattatatttattatactttaatttagaagggattaatattatgaattggattgaagatataaaaaattataaaccttacaatgaacaagaatctaaagataaagatttaatactaaaatgtataaatcttcatgatgatatattaacaagagaaaatactattgctcatataactagctcaggatatatagtaaacaaatcaagaacaaaggtattaatgatttatcataatatttataagagctgggcatggaccggtggtcacgcagatggtgattctgatttacttcatgttgctataaaagaagctaaagaagaaacaggtcttaaaaacgtaactcccgttatgactaatatacttggattagatgtacttaatgttaatggacatattaaaaaaggtaaatatgtatcatctcatttacacttatctgttgcttatctattggaagctaatgaagaagatgaattaattgtcaacgaagaagaaactagtggtgttaaatggttacctatcaatgagttaagcattcactgtaatgaaccttacataataaatactgtatattctaaatttaataaaaagataaaagagctgaatttataaattcagctcttttatcttattcttgtgataactttttatagttttcaaatctttccttagcatccttttctgtcttagcaaataattcttctgctagctctgggaacacttttgctaaggctgcgtatcttacctctcccattaagaaatctctaaaatctgattttggttctttagaatctaatataaatggattcttttcaccctttaatgttgggttatatctataaaggttccagtaaccacaatcaactgctttcttttgttcatctggtgtattagtcataccttttttaattccatgactaatacatggtgcatatgctattattaatgatggtccattataactttcagcttctgttattgcttttattgtttgatttttatcagctcctaaagaaacttgagctacatatacataaccataactcatcgccatcatacctaaatcctttttctttgttctctttcctgaagctgcaaacttagctattgctgcagttggagttgctttagatgcttgacctccggtatttgaataaatttctgtatcaaatacaagaacatttacgtcttcattgcttgcaagtacatgatctaagccaccataaccaatatcataagcccaaccatctccaccaaatatccattgtgatctcttaataaaaaattccttatcttttaatatttcttttgcaagttcatcactacatccttgtaatgcagtttctaatttttgagccctttctctagatccttcacctatatctttattgtttaaccaatcttccattgcttcttttgcactacaacataaatcttcatctaatgcttttttaatatttgaagcaactctttctcttattgtctttgctcccataaacattccaagtccatattctgcattatcttcaaatagtgaattagcccatgcaggaccatgtccttcttggttctttgtatatgctgttgctgcacctgaagatgcccatattgaagaacatcctgttgcattagcaattaccattctatctccaaatagttgagtaaccaattttgcatatggtgtttctccacaacctgcacaagccccagagaattctaaaagaggttgttcaaattgacttcccttaactgtattcttattcataggatttttcttattctttatatcctctacagcataattccatgcttctatttgatcatgttgtgaatcaaatggtttcataataagcgctttacctggtgctggacaaacttctgcgcagttagagcatcctgtacaatcaagtggtgtaactcctattgtatagaaataaggtacatctcccttaactcccttagcttgaagtttcttaaagctttctggtgcgccttttaattcatcttctgtagataagaatggtctaatacatgcatgaggacatacatatgaacattgattacattgtatacatctatcaggaatccattctggaacattaactgctattcctctcttctcatatttagtagttccatgcataaaagtaccatcttctatattattatttacaaaagctgatacaggtaaattattaccttcaagcttattcattggaatacaaatatttttaacaaaatcaggaacagatatattttctttttcttcatctccagtcgctgatttccatgactctggtacatctatcttaattactgattctaatcccttatcaatagcagcataattcatatttactactttttcaccttttttaccatatgaagtaactactgcttccttcaaatatttaatagcttcatcaacagggataatattagcaagcttaaagaatgctgcttgcattatcatattaattcttcctccaagccctatttcttgagctattttaactgcatttattgtatagaagttaatattattttctgcaatatacttcttcatttttgctggtaatttttcatctaattcgtctttactccaaattgtatttaatacaaatacaccattttttcttaacccttctaaaacatcatatgaatatacatatgattgattatgacatgctacaaaatccgctttatctatttcataatgagcctttattggatttttaccaaatcttaaatgtgaaatagttattccaccagattttcttgaatcatatgcaaaataaccttgagcatacatatttgtatgatctccaattattttaattgcgcttttattagctccaactgtaccatctgatccaaggccccagaacttacatgctgttgttccttcaactgctacatctatttctttatcagatattaatgataaattagttacatcatcagtgattcctatagtaaatctattctttggattatcactctttaaattttcataaactgcagctatatctgctggatatggatctttagaacctaatccaaatcttccccctactacctttggaggattatccatttcatttactgctcttaatacatctaaatatagaggttcaccaatagctcctggttcctttgttttatctaatacagcaatctttttaaccgtacttggaatagtatttaataatctttcaatactaaatggtctatataatcttacttttactaacccgactttttcacctttatttattaaataatcaattgtctcttctacaacttcgcttactgctcccatagaaattataattctatcggcttctttatctccatagtaatcaaaacaatgatattctctacctgttaattctgtaattttactcatatattcttctactacagatggaatatcatcataatacttatttagtgattcacatagttggaaataaatatctggattttgcgctgttcctctagttactggatgacttggatttaatgcgctttttctaaaactatcaattgcttcataatctataagtttagctaattcatcatactctaagatttcaattttttgtatttcatgagatactctaaaaccatcaaaaaagtttacaaatggaattttagcttttattgctgttaaatgtgcaactgctgataaatccataacctcttgaacagacccttctgaaagcattgcacatcctgtagctcttgcagccattacatcttgatgatcaccaaatatacttaatgatgaagttgctagtgctcttgctgctacatgaattactcctggtaatctctctccaaccatcttatacatattaggtatcataagtaataatccttgagatgcagtatatgtagttcctaatgcaccactttgaagtattccatgaagtgctcctgctgctcctgcctctgattgcatttctacaactttaactggttcaccaaatatatttttctttccttgtgctacccattcatctacatgttcagccattggagatgaaggcgtaataggataaatggaacttacttcagtaaatgcataagaaatatatgcagctgcagtatttccatccatagttttcatttttctcatatttttgcctctctttcattagtttttaattttatactttaggcttctttaaattaattttttcattctttattagtattgaaaaaatgtaaaatattatgtatattacttttaaagttttttactttttttaacaaatatattgactgtatatttttttagatttatactaataatataaataaagataatatcgcggggtggagcagtcggtagctcgttgggctcataacccaaaggtcgtaggttcaagtcctgctcccgcaaccaaaaaaggatgtcatatgacatccttttttcatttatatctttatatttactttagtgaatttacagacataataaattgttttgctactctattagatctaccactacttaatgctgcccacttaattgcttccccttttaatgtttcctttggtaaattaatattataaatttcagctagtttgtataccgtatttaaataatcattttggtttcctactgaaaaagtcaatgttattccaaatctttcagctaaagaatgcttttcttcaactgtttctctagcatgaatttcttcgccttgtctatcattaaatccttctcttattaaattccttctatttgaagttgcataaatcaaagcatttttcggttttacttctaatccaccttctattaatgctttcatatttttatattcatattcaaactcttcaaataaaactcctcattcttctacccccattaaaacaaaattaattatataatacattttcatccatttttattcaataaaaaaaagatatagagtatttatttaatactctatacccataatctatatccttaatactcttctttaaataatactgcttttatctattttctatttattacttttacctgtataccttccataacatcaaaagctttttcatgtaattcttcattaaatcctgcacataacttagcatcaactaaaatttctgcattagtatattgtgattgaaacattactacattacttattacacaaatatttgttactacaccaataatttcaatacaattaatattttctccaagtttttcacttaattcaatcattttaataggcgaaataccaaatgctcccttatttatatggattgtatttttattgttgataaattcactaagttttccataaagttcatgtccttcagtatttaaaatacaatgggttacaggtaaattcttaccttctctagttgttaaataatcctctgtatgagtatcatatgtaaatactactctatctccttttgacaaataactatttactttttcatatattccctcttctatttctttagctttttcaaatcctaatgctccatctacaaaatccttttgataatctactacaaccaatactcttttcattatccatcctcctaactataaattaattaaatatattttaccacaacacctatctaaatgttacttctgtatatacacttattttgaaaaattccatatttaatttcttaaaaatttctgatatttaacttttttacctttattaaaaggttaatcttttatataatggtaaagtaataaattatatggttaaattttggaggtaatttaatggaatttttagaaattataaaagccataattctcggtatcgttgaaggggtaaccgaatggcttcctgttagtagtactggtcacatgattttagttgacgaatttttaaaactaaatgtttcaaaagaatttatggaaatgtttttagtagttatccagcttggagctattttggcagttattttattatattggaaaaagattttcccttttaaatttgataatggtgttaaagttgaaaaagatacaattataatgtgggttaaaatattaattgcttgtgttcctgcagctatagtgggacttttatgggatgattatttaaatgctttattttataacccaactactgttgcaattatgttaattttatttggtatcctatttattgttattgaaaactacaataaaggtaaaaatcctaaaataaatagtttaacagaaataacatatacagttgctgtaatgataggtttatttcaattaatagcagctgttttccctggtacttctcgttctggtgcaactatagttggtgcattattaataggtgtttcaagaactgtagcagctgaatttactttcttccttgctattcctgttatgttaggtgcaagtgcattaaaacttgttaagtttggattaaagactggctttgttatgactggaaatgagcttactatattattagttggaatgattgttgcatttattgtatcaattctagcaatcaaattccttatgtcttatattaaaaataatgattttaaagtatttggatggtacagaattgtgcttggaatattagtattagcatatttctatattataagataatctttacataaaaaagactgagtaaacttactcagtcttttttagtacaactcataaatatctgaaaactcaatattaatcttttgtactaatggttggttttctgcctctattatcctactattattatcattatcttcttccattcttacatttggaagctttataacaatctcacagcctttttcaacttctttttctaaataaactattcccccatgaagttctattaaggactttactaatgaaagcccaattccacttccttctttctttctattaaaagatttatcttcttgaacaaatctttcaaaaacatgctcactaacatcttttgatataccacttccatcatctttgactctgattgtaacaaattcatcatccgcatccattaaaacacttatgtttccattatcatcagaaaatttgactgaattagataataaatttaaaattactctctctatactttcaggatcacattttattataagttcttcaacgtatgtatcaaataaaacattaatattttttgcttcaacataaggaataattgacaacgtaatatcttctactaaactgacgatttcataatttccaaagttaagattcataaatccagaatctatctttgtaatatcaacaagattatttactaatcttaataatctaaagcaattttgttttatagttccttcatatttgcaataagctttccataaagcattttcaccttgacttttgctaatttcaagtaattgaaaacatgaataaattatattaataggtgttttaatttcatgtgataaatttgcaaagaactgagtctttgctttttcaatctctttaatttcattatattttttttgaaagtctcttaaattattcacttgattatttaatttattacttacttctattcttctaacaacttcaacatataatccaacaagtaaaattaaatatgctatagtacttaaaaaactattataaactaatactttctctgcatatttagaaaaaatatttaaataaaaaattcttctaattgtaaatatacttatagtagtaataaatatggtgtaaataaactcattttttcttatacacctttttactaggctaagtaataatattacataatatattaacaaactacattgaattatattccaaagataaatactttttattgaaaatatattgcttaaatttaatttcacttccataaatgtccctataatatttattaaaataattaatattacagaaagcttctttctactaacaatcttatatgcatatttactttcgtttaatattgcaatagtaagtaaaaatattcttactacaaatggaaatgttattaaatgcgcacttaatccaatattttcaattataaaatttacaaaaatacattcaataaatatacttatatatgataatttcaaaataaaaaactcattatttttgtatatgtaataatataacaaacaacatggaattgctattaatccaagtaatacattaattgtattaatatcttgtataaatatagttctttttaacttatttatatctaatatttctataccaacaatggaaaaacataaaaataataccgttccaattaacatatataaaatatatcttctacttttcttttcatattctctaatactattctctttcatatatccccttaacatttgtttctaatattattttttagcacaatatttacatgattatatcatattttctataatattggaaattaatttctaatattatgaatcattaattaaattattgctagaattttttcattagtttgcatatactatcctaagcaataatttaagtgatattatgaactataccatagaattaaatgattgtattttacttgggtccggggctgaaggaagtgtttttcttactccagagggttttgctattaagcagtttaatacaataaaagctgctaaaaaagaggtttctattcttgatgatgtaaaggatagtcctttttttccaaatgtattgattagagtgagcaatatagttgttagagaatatgtccaaggtgaaaatctctatgaatatattcaaaaaaaaggcttatcatattctctttctaaagaaataatcgatctactagaagatttaaaaagattaaaattcaaaagacttaatgttagaaatgctcatatttttattgattctaatgaaaaaataaaaattattgatccaagaaaaccttatgtaaaaaacaccccctatcctaaagacataattaaattgcttttgaagttaaaagtatttgataagttcttacaagatttattaaattatagacctgatttattagattattggattgacggatataattatgtagccaataattacagacatgtactaaggtactgattaaaatattactatataatattttttagtgctaaatttttaagtggtaagttaatattgaaactcctaacggattttctaaaaatatagtttgaactaaatcaacttatatttattttttaacttaccactttaatttactgcttattttttatttctttcttactaaattagtattaaatttagctacatactttcgattgatactacatcatacccttgatcttcaattttttctttaatttcatcattgttagaagatgtttcaactactgcatacttctcttctaaattcacttgaattttgcctgaatcttttagttctgctaaagcttcttttacatgatttacacaatgattacaactcataccttcaataaatatcttttttaacattaatatctcctccttaaattatcaaaaccaaatataaaaatttcatatttatattgttaattttatttaataaaattatttataaaataattattttttactaattaagttttaagccttaaacttcttaagtcttaaagcattcgctaatactgaaactgagcttaaactcattgctgctgcagcaatcattggattaagtaatggtcctccaaatatgtgtaacacccccattgctacaggtatacctaaaacattatatccaaatgcccagaataaattttgttttatatttcttattgttgctttacttaacttaatagctactataacgtccattaaatcacttctcataagtactatatctgctgattcaatagctacatctgtccctgatccaattgctatccctatatctgcttgtgctaacgctggtgcatcattaattccgtctcctaccattgcaactttattatcttttccttgaagctttttaacttcgtttgccttatcttcaggtaacacctctgataaaactatatctattcctacttgttttgcaatagcttcagcagtctttttattatctcctgtaatcattgcaactttaatacccatatcatgaagttctttaatggcagtaatactacttggctttactgtatcagcaactgcgataattccttctaatgaattatttattgcgataaacataggcgttttaccttcctgtgctaatctatctgattcaacctttaattcacctatatctatagacttttctttcattagctttaagtttcctagtaaaatagattcattctctattactacctctattccatgaccaggtattgcattaaagttctctaatgattttaattcaatatttttttctattgcttctcttactatagcttcacctaaaggatgttcagatcccttttctgcacttgcagctaaagctaataatacatccttttcttttcctctagatattatatcagtaacaactggttttccttctgttattgtgcctgttttatcaaatactatagtattaattttatgagtaacttctaatgcttctccacctttaattaacaccccattttctgcacctttacctgttccaaccattattgctgtaggtgttgctaaccctaaagcacaaggacaagcaattactaatactgatataaatattgttaatgcaaatactggtgtttctccagctattaaccatgcaattgctgaaaaaatagcaagcccaattactattggaacaaaatacgctgaaataacatctgccatctttgcaattggtgcttttgatccttgtgcatcttcaactaatttaattatttgagataatgctgtatcttttccaacctttgtagctttatatttaataaatcctgttttgttaatacttgcacctattacattgcttcccacagctttttcaactggtatactttcgccagtaagcatggattcatctattgctgttgaaccctcaataacttcaccatcaactggtaatttttctcctggcttaactaatattatatctccaactacaacttcatctattggaattactatttcattaccttctctgataatagttgctgtttttggtgctaatcccattaattttttaattgcttcagatgtttttccttttgatattgcttctaaatatttaccaagtgttataagtgtcaatattgtaaccgctgcttcaaaatataaatgcatagcatagcttgtatcaccactagctattttatacattccaaatacactataaagaaaagctgcacttgttcctacagctattagtgaatccatatttggacttaactttatcaaatttttaaatccaattaaatagaatttatatcctatagccataaccggaactgttaatataatttgaaatacagcaaagttcattggattaaccataggatctattatcttaggcaatggcattcccaccatgtgtcccatagtaactattaaaagtggaatagtgaaaatacatgagaaaataagtcttcttaataatttatctttatcagatatttttttttctgtattttctttttcctcttctcttacaagcttataaccagctttttctacaactcttttaatatctccgtaagttactatatcgtcatcaactgtaatactcattttttcagtagttaaattaactatcgaatcctgaacaccttctattttttttgttactttttcaactctaccagcacatactgcacatgtcattccttctaccttataagtataagttttaatatttttaattactgaatacccaagagattcaactttgttttctatttcatttgatgttactttattttcatcaaaacttactgttaatgtttctgtagtaaaattaacattagcatccttaacgccttccatttttttaattccacgttctactctatttgcacatgcagaacatgtcattccaccaattttatattttttatccatttaatttctctcctttccttatttagatatcttctcaaaaagattcattatttcatctatcttttcatcgccattattatttattatcgcctctttaacacaatgatctaaatgcctttttaaaatttgcatatttgcctttttcaacaatgattgaactgcaattatttgattagaaatgtcaatacagtatctttcatcttcaatcatttttattattccttcaatttgtccttttgctatttttaaattttgaattgctttttttctttcttccatagttctcctccatatccccctccccaggggggtatattaaaattataatactttttatttctatgtcaatattaatattttttattatttcttattctttatacaaaattttattgctacttatccctatatttatcagatatattttttaatttcttaggttaaactatttatgtgttattagtggaaatcttttatagatgcaaaattaataactaatttaatattttagttaaaagaggtgaatgaaatgagtaaatgttgttcaaaatctgatcctagctgtaaggattatgcagaaaaagtaaaaaataaggcaaatgaaaaaacaccttatgaaattgataaaccaactaaacatttttaaaattaaattttcaaatataaaattaatatgctcctcatatagttttatcatttaaattagatactatataaggagcatattttattaatttataaaattttatttatttttataactatctactaacatcataaagaatttaaataatactactgatattataccagttgttatgtacatttgaattccagctatttgatttacaatataaccaaaagtttcatatccttgacctattaagtaagcagacatctttgttgaagctacaattcctatagccatagggaacgtaagtcctgcaaatcctggatggaaaatatatgagaagaattttggtaatttgcttattatgaatattaatgcacaaattactgcaaagtataaataataaactataaatttatttggtgtttcaataaaattaaggtaacttactaaacaaagacttgatggtgcaagtacaattgcttgagtatgatacattggatcttttatttcatattttgctaatctataaatcataaatggaattattatagtaaatactgcaataccataatatacaactattttacctattaaaggttcattcataactccaccaactactgtagaaaccattataccattatatgtaacaaaccaacttggaacgaaagtttgcatattaacaccttttactacgtttttgtatgtaaatattagaatgtgaattgcatgtaatattaaacctataaaccaaagcgccttaccaaaagccgcattataagtataaatataactacctataatcatagttatcattgtgaatcctgcataaagtgatgctggaactgtatttgaatattcattttttacagtatcaaagtgaacaactattttaactatatatgctattaaaaccgcaattgctgcccatatagttaaatgtcttacccatgtatatcccatacctgagtacacattcgctaaagttgatgcccctaccatggttggtaaaattggaactggtaagtttttaatcttttgtattagtgacttattattcatgattcctcctaaaatttaaaataaactaataaataagttctatatatagcttgtgtaatagagtgaaattaaattcacttgttaattttttcacttttcatttaacaaatttacttactcactcatcaacaatagttattatacttatagatactattcaagtatgtgatttttatcacaatattgttaattttttaattatttttttaaatattttattaaactaaaaatataaaataatattaataaaaaagaactgtgttattacagttctttaattttgtcgctttataaaagttatgctataaacttaatatctttttcccagtatcaactaactcgcatttatctcctactctaacttttccaccttttaatactcttgtgaaaattccattcttaggcattatacactctcctacttgatagtatattgcacatttatcatgacattcttttcctatttgagttacttctaaaagaacatcatctcctacagttaatctttgtccaactggaagcttatttaattcaaatccttcaataactaaattttctccaaaagcgccaaaatcaacatttccacctttatttctgaaatcttctattttttctaaagctaaaagacttacttgtctatgccactttccagcatgagcatctccttcaattccaaactcttctataaaatttgcttctgaaacttcattttttaatgttcccttatgtttacttgtacaaatagcaattacttttcccatttcttatcctccaatttgattcataaactttaattctttattctcacttttttctgaaaataaatgtttttctggtttgtcatatatattttcttgtataatttctcttaaattttcgtcactaattccttttctaatcttagattttaaatctaccccataatcaaagtgaagacattgctttaaaaaaccttctggagttaatcttattctattgcaatcttcgcaaaaacaattgcttaatgcacttataaaaccaaccttaccttttgcgccttttaacttaatatatgtagctggtccgccacttttacttcttactactttttcataatcagtataattttcttctataacctttagtacttcttcatttataacacctttataattaattgcaattccaattggcattaattcaataaaacgtatatctataggtttctctttagtaagatttacaaaatcaattatttcgtctttatttacatcgttaactataacagtatttaattttacttttattcctaactctattgacttatctatggctgctaaaacattctctaacttacctaatctagttaatttactaaatctttcttcttttaatgaatctaaactaatgtttacacccttcagtccatttaactttaattcttcaagtttatcagctagtaatattccatttgttgtcagataaatttcttcaatacctggaatattatttattctccctataagatttactattcctgctctaactaatggttccccaccagttattctaattttttttattccaagtttagcgctttcttttataactttatatatttcatcatcagttaacttttcatcattttttaagaagttattttccttctccttcatacaataaacacatcttaaattacaattatcagttaccgatacccttaagtaatcaatctctctttcaaacttatctttcatattaattcaaagggtaagttaaaagttaaactccccactctttcctcctgtttttttaagcaaatgagttccttcgataaccattcttttatcaactgctttacacatatcataaattgttaatgcacttactgttgcagctgttaaagcctccatttcaacccctgttttatcaactatttttactgttgctgtaatttcaatggaactctcttctttatttatctcaaaatccacattacaacttgtaatcattaatggatggcacattggaattaaatttgatgtttgtttactagccattattcctgctattctagctactcctaacacatctcctttaccaatcttccctttttctattaactctaatgtttctctactaacttttatttttgaaacagcaactgcaactctagctgtttcatttttttctgatacgtcaaccattctagcatttccactattatcaaagtgtgtcaatttattatccataatacaagcctactttctaaaattattttccaaatgaacaatgcgggaatgtacatacattacaatctaaacataatccaccatgtccatattcgactatatcatcaattgttaatttttcatcacttaaaactcttggtaatactaaatcaagtactgttcttttagagtacattgcacagcttggtactcctaaaattggtgtatcaccataataagctaataagaacatagcccctggtaatactggagatccatatgttactaattcaccaccacattccttaattgctgtaggtgtaacatcatcaggatctacagacattcctcctgtacaaattatcatatctactttttcactcaaacctttttgaatttcttcaataattctttccttttcatctggtaatattacttgacgtattacttcactaccataataccctaatttttgctttattactggtaaaaaggcatccttaattctccctttatatacttcattaccagtagttattaataaacactttttaggttttatttctgctacactaattatcttttctttaattaaattttcagcagtaataattttttcctcatctattattaatggaataacccttgttgctccaactttttccccctttttaattggagtattattatgcaacgtagaaactataatttcaccaaccgaatttaatttgaacaaattatctttatctatttttaatactccatctctatcagcaaagaaatctacttttccttctttaatttcatctgaaagcttaattccttctcctacaactaaatttgaaattcttgttgctgcatcattttcatgaagctgaccttctgtaggttcccaaacataaacatgttctttcccaatagatagtaatttttctatatcttcttctttaattatatgaccttttttaaataatcttcctttaaattcaccaggaattatttgagttacatcatgagaaagtatagttcctactgcatcttctacttttatcattttcatattaatttaccccctattactttctagcacattcttttgaagttcctaataatatatcaattccgtgtttaatatcatctaatgcataatctaatgcttccttacaagcctttggacttcctggtaaattaacaattaatgtatcttttcttataccagacacagcccttgaaagcatagctcttttagtaatttgcatactatacattcttattgcttcgcatattccaggtgcctccctatcaattattgctttagtagcttctggtgttatatcccttttagaaaatccagttccacctgtacttaatattaagttaactttaagctcatcactcataactttaaattcattttctaacatttctttttcatccggtaatatgacttgttttactacagtaaatcccgcagcttcaactaactcttttactacagccccacttttatcttctctttctccagcataacctttatcactacttgtaattataccaactgtatacattataattcctccaattctttatattctttttccgtatttatatttaaaaaatctttttcaataaattttttttcttgatttccatctataactttataatttaaagattttatcaataattgaagtttattattatttttttttattgcattttcaatactaggaatgctcttttttgaatatactgcacataatggctgtagccttccagaaacctccggtattaacacttcatattctccattataatttcctaatacatttaaagtttcactagttataagtggcatatcacatgctatacataaaacttcatctgtagttgaattcataagagctgaatgtattccacttaaaggaccattccccttatatatatcttcaattactcttaaattaaatccttcatattcttcttttttatttgcaattattattatttctttataatctttacctgcatcaattatatgttctataaatttacgctccttataatttaataacgccttattattatagttcattctactacttttaccaccagctaaaatagccaatgtcttgtttatcataagcatctatctcctaaaatttaatgatatcaactgtttcaccactgtgaagagcttcgcttccaccctctacttcaatcatacaattagaatttaaattagaacttaatattccatttccacttttcacttgtgttatatataccttttgttttccatcttctattacaactctacccctaataaatcttctctgaggactttttttattgaaattatcacataaagttgctttttctcttttaacttctattttttcaattccacttaatttttctattgatgtcttaacaaacaactcaaatgctgttagtgcggcagttggatttcctgacaaactaaccacaatagcattatttacaatactacaaagtactgctgaccctggtttcattttaaccttccaaaataatcttttcccacctatattgtctattgcatgatttaataaatctttttcacctacagatactccaccagttgtaattattaagtcaacattttgagatatattctctatatatttctctatatctccttcaacatctcttacatgctttacttctaaaatattatatcctaactcagaaactctcgccattatagtatatttattactgttgaaaattttaccttccgttaaatcactatttacatctataacctcatcaccagtacataaaagtgcaattttaggatttttatatacctttatctttgcaataccagcacttgcaataatgcctatatctgcaaaatttatctttctatttttatttactaatagagatccttttttaatatcttcacctttaaaacaaatattatcattagcttttatttttttagttaatgttatatactcgtcatcatttttgatagtatcttcttgctttattactgcatttgctccttttggaataggagccccagtcattattcttattgcagttttattagttacttcacaattacttacttcaccagcaaagaccttatcaatgatttttattttatcattagaaccactattttctgctaatattgcatatccatccattgctgacttattaaatggtggattatcaattagcgaatatatatcctctgctaaaactcttcctgttgcatttattaagtcaatctcttctgttcctatggctttaacattttcatctaatatatctattgcctcttccaatgatataaatgacttcatttgatatcctccttaaaatataaaagacttactacttcatattttagttatgagtaataagcctcaaatataacaaaattatttttagttatatataactaaaaataaaactatatatttaaacaaaacttattttccttcccaaaacgtggagataatatcttttcaaatattaccctttaaattttatttcaaatttcggcttaagttccttagatttactccttaggatacttagctctagaaaatatattattgataattttcaaacttaaattcttcttctttttcaattaaatctacaagtttttctacatcgtctttattcacaacatttatattattatctagatctaaatgggtatcgcttgcaatagctattaacttttctttttgagttataatcctatcacttactccatctctataaacttcgatttttcttaagttactatttttatatccttcaactaaaattatatctttatccattaacattttaattatatcactaagttcaatctcttcgtataattctttaatcatagcaaatctattttttgatgaaattacaaccgtttccgaacctgcttctctatgtttatatgtatcttttccttttttatctatatcaaatccatgaacatcatgttttatagttgctatactataccctctgtttttaagttcttttattaaagactctattagaaatgtctttccaacatttgagctataacctacaatatttattacctttgacatttagttcatcccttagtctttattttatctttatattttaaaaatctgctttgattttaaatcttattaacatttttgtaaatatcttttatttaaatttaataagttagaggcaaaaggttatttaatatatattaaaattctctccctctccctctaactttttttattatatattcactccccaaactaccaagtagttaacttccactagctaaatcagagatttaacgtatcagttgaaatttgggatcttataaaggaaactcgactcctttcagtcgctgagtaagttcgtcttaccaaattaaaatttggagacttacttaggaaactcgactcctttcagtcgccgagtaagttcgtcttaccaaattaaaatttggagacttacttaggaaactcgactctcctggcccacgccttagaagggcgttgctctatccagctgagctaaacacgcataataccaaagaacgttttttattttaaaacatttctttatttatgtcaagcttttttttaaaagcttttttggagcgggtagtgggaatcgaacccacctttccagcttggaaggctggagtattaccgatatacgatacccgcatattctttttaactaatttcattagttgaattggtcggggtgacagggatcgaacctgcgacctcatggtcccaaaccacgcgcgctcccatctgcgccacaccccggtaatcatcttctttcatctcgctacatctcgcagcgacaatgattattctacatgatgatttttaatccgtcaacacttttttttatttttttttattttttttattttatagctcttttatatatgtaataggatctttttcttcaattaaatcaatatatcctaaagttttatctactcttcccaaccctaatgaaacacttcccggattcatcaaaattaatccatcctcttcttctataataggtatatgagaatgaccaaacaaaactatatctgctccaacttcttttcctctgtaaaaaatagaattatatccatatttcactccatatctatgcccatgacacataaatatctttttgccttgaatctcaataattctttcttctggatataatcccctcatatcacagtttcctctaacagcatatacctctcccttaaactcctctgtaatttctcttaaatcactttctccatcacctaaaaataaaagtacatctgcaccactaattctttttttaaccttatctatactagttctatttccatgtgaatcactcactacagcaataagcataaaatcaccctttccattaagttaataattaatagtttatagttaatagtttatgttgaaactccttaaatagtttctttaatatattctaaagtctgtctaaacagactttattccttaactcttaactcaaaactattaactaaattaaaactattaactaaattaaagtatttctttaagctttttaagcgcatttcctctatgagaaatagcatttttttcttctgccgaagcctctccaaaggtcttattaaatcctttatagaagaataatggatcatacccaaatccaccctcagtttttagttcttcaataatatatccttcagcttctccacgaacaactttaatatcaccattttcatcaactaatgatattacgcaaacaaatcttgcttttctatcatcacccttaaaattcttcatttcttctagcaacttaatattatttttatagtcattcccatgctcaccagcatatctagcagaatacactccaggcgctccatttaaactatccacttctaatcctgaatcatcagctaaaaccagaaaattatcttctcctctttttttcaaatataaataaatttcagtagcctttttcttagagttttcttcaaaagtaattccatcttcttctacatctatgttaatatccatatcattcagagaatatacctcatactctaaaccattcagtatatctttaatttcttttattttcttagagttattactagctaaaactatttttttcatattattctccatctcctgttccaatccataaagaatccatctttaagcaatccttttgtaattgaatcatttgctttattcctttttcagctaaatctaataattcatttagttcagttctattaaatggagcttcttcacctgtaccttgtatttcaacaaattcaccatcatcagttccaatgacattcatatcaactcttgctgttgagtcttcctcatagcataaatcaagcaacttttcttctccaacaattcctacactagttgcacataaaaactttctaattggataaactttaaatggtttttgtttgtgtaatttattcatagcatcaactaaagctacaaaagctccacaaatagaggtagttcttgttcccccatcagcttgtataacatcacaatctatccaaatagttttttcccctaaagcttttaaatcaactactgatcttaatgctcttcctattaatctttgtatttccattgttcttccatcaatttttaacctcgctatatctctcggttttcttgttgctgtagaacgtggcaacatattatactcagctgtaatccaaccttccccactaccttttagaaatggtggtaccttatcctctattgatgcagtacaaattacctttgtatctcctacttctattaaaacagatccctctgcatgttttatataatttctagttatttttgcatttctaacttggtcatttcttcttgctccactcctcattgaaaattcctccatttcataattttacttactatatattaaatttctcctttttttaaaaataatgcaacaaattctcacttaactcataatattaatataaggattaattaagaggtgaagaatttgagatatattgggccattttttagaatgaatagcctttctgaaaaggaaattaacgggcaacttttttatttatctaaagaagcagtaaaaactatagtgctacaatccaaatgtggtttagtttctaaaataaaaaagaataaatcatcttcctccattgatattagcacaaatagtaatttttctccactattatgtgtttacagaaagtcatctgcaaactttattcatagtaagaattcaaatggatttgatgaagattcttttaagaaagaaattaacccaagcactaacgctttaatgactttatgcatattagaattactagattactataggagttttgaaaacatagatagtagcaattatgccttatacgatttatacaatagtatatctaaggatcaacttgaattttattcttcaaacttacgaaatggagaaggagttttcgtagataaaaaaaacttactagaaaacaatgctagaaactttaatttagttgataaagataataaatttaaattttccgatcaagctttcatgatgcttgcatattatatgttttctattaagaatcccaaagatgaagtttcagaatcatatgctgagttttcattgcaaattttaaatatgttttatgattttaaagataaattatacgaatgttcattagatgaaatttgcaaagttctactatcattaaatattttatatagctataaaagtgatgatgagcttaaggattttataatagatttggctgattattcaatgtgtaaatttgatgaaaaggactattatgttaattctttagattctgctgccttgtgctcattagttttaaccttatcttataaacatacgaaaataataacatttttagagaaatccaccgaaataataaatagattatactctttatatgatgaagataagggtgctttttataaattatcatcaaaaaaagaaattaaatactcctgttttgatattactttttatattttggcctttattatttatgatgatgtatctactaattcatctgagcatagaaatatgatatctactgtttatagaaaatttataataaactctggaataatttctagctggccagaagcccctacattagatgattatgaacgttatagagggtttactttaagctcaaaggatatggtagatgaaagttatttcagaatgccagacattcctaccccagaaggcaatggagttgcacctatatttaataaatatgttacttataataagcgtaaagatactttttctaatactaagaacacctttgatagttacaggaactttttaaatttcttcttacttattcatttatttaaagatgaatatatgaatgaattaggattgattcctgttcagacatctaatactgatgatatacgtgataataattcaactactattgaagaatcagatgattcaattcctaagattgaagcagatattgtcacagaaatcccatgtgatgaattaacatctaattctgtggataacacctttatatctgttgatgaatcaagtttaactgaattaagtaatatcgataaaaacaataatgatgctaaaccaacattgtctaattaataaataaagtcggcataagccggctttattttgaattacatccttatttaatggcactaaaatctatattaccattcccgtctaaaatattttcatctttattatcattaactgctatagtattgttataaaataatagtggtaatactctatgattattaaaaagctcttcttctatctcagcaaataattcttctttttcagctttagaattcgaattatttatcatatctctttcattttttggaagaaaacttgatattgtagaaagaagctgttcatcatcctctaatttagcatatacatttactaatgcaatatcataataatttttttcactaattaaattcatatcatcttctgtaagtaaattacaaactaaggttatatctgtattttccttaaaccacgaagttaaataatcagttatatctttgttttgtaaactttcttttgcaacaagaactattttgcttggcatttctacatcattttttaaattaaccataacatttctgctttgcaactttgttaaatcatccttgtcttctctaaaatagctacattcagctaattcaagaagtaaatcatttttattttgatattcctctatagctttactaactaatctatatatttcattcttgacttgatttgaaaagttttcattattcccattaaaggctaaataaacagcttcatcagatggagtttctactaatttaccttcttccttaagtctttgtaattgacttgtaggtggattcataacaatatctctttcacctatttcaaacgcagctaatgccaaatcttcactatcatccttaactaaatgtattgtttgagccaattctacatttgaattatcagctctctttaaaattatttcagagtcactcattgaagaaatacaataattacctgaatacgaaattgaactataattcctatctatattctcccaaaacaacaattcttttcttactctatactgtggcttagttagctcctcaacaaatccatcatcctttgaattcaatctaatctttaagctatcttcagtactagttatagcaacagtattcgcaaatgaattatttccatttatataatcttttactccaaacacatttaacagtgcagaaatttcattctcttctgtaattacttctctaaaaaaatctacaatatcactaggggtaatcttacttccatcactccaataaatatcatctctaattttaaatacatactctaatccatcatcactaacagtatagtcctgagctaaaaccggctgtatattaccctcagaatctagctctactaatcccttgcttgtagcgcatactatatcttgttcccttttgcttaatttaccaatagattttaaattttctggtatacttgttattgaataaacaatatccccagtattacttatattttcttgtggtgtcttatctataaaacttaataatataattattgttacaatcgaaacagaaatagctgctattatctttttcaaatttatttcccctctcttgttatacttttctataattatagacataattataaagaattaatctttttcaataataagtaaattatttttatagaaattttcccaatttatgatataatcattgtaaacaagattcaaagttttatattttgttaatagaacttaactgccactctaaatcttagatttagttagtagaagttaaactacgtgtactcactgactgaaaagtattgagtttccgtttacaaatttatggaggtactaatcatatgacaactgcaatgcaaatagttcaaataatatttcaatcagtagcaataatatttatgatttgctttatgttcattggaatatggtctttcatagcctttttaaagatgcttaaaaatcaaagaattcaaacatatttacttgaaaaaataaataaaagcatttcatcacttgaaaataattcaaagaaaaatgatacactttatgaacctgagttcttaatggatgattcaatcactaacgatgatgataacattataaagtttgatgataatataatataaatataatataaaaaagtagttacaaattcatttgtaactactttttatatctaaatcattttttcaaattcttcttcagttaaaacagtaactcctaaatcttgagctttagtcaatttagagccagcctcttctcctgcaataacataatcagtctttttacttacacttcctgaaaccttagctcctaacccttcaagtttagcctttatttcacctctagagtaattttgcaatgtacctgttactacaactgtcttaccattaaaagaactctctaatattacagtttcttcaaatataggttttactcctaaattaaataattcttctattgtatttaatactttttcttcatggaaaaattctaatacacatttagctactatatcaccaacatcttgtactgaaattaactcttcaaatgtagcattttttaatccctcaatagatttaaatttatttactaaatctttagcagttttaactcctacattaggaattccaagtgcatatataaatctatatagttccggcgtcttgcttctttcaactgcatctaaaagattttgtgccttctttggtccaaatttatctaaagttaatagttcatcaaaattaagtttatataaatctgctattgatctaatgtctaacttttcgaataattgctctgctgtcttttctgagaatccctcaatattcatagcatccctacaagcaaagtgaactatactctttactaactgtggtttacaagataatgtattttcacagaaatagtgcgctccatctaaaactaaatgacttccacatgctgggcaagtttctggcacttttatttcagtagcattttctagcgaagattctacaacacccataatttcaggaataacatcgttagatcttcttataaagacttctgctccaatcattacaccttttcttttaatatcatccatattgtttaaagttgctctttttacagtcactcctgctagttctactggttcaagtatcgctgttggaccaactcttccacttctaccaacattccattcaacatctaaaagcgtagtagtagcttcttgagcttcaaacttaaatgcaattgcccattttgggaatttaatagtatacccaagcaagtctctcgttcttatgtcatcaatggcgataactactccatcaatatcataatttaaatcaaatctcatttcttttatttcatctatataatttttaacatcatctaaattatccgcatatcttatatatgaatccataggaagtcctttcgcctttataaagcttaacatttcctcataacttttaaagttttgtccttctttataacctacatcataaaagaacgcagaaagtcctcttcttgcggtttccttaacatttaaatttctaagtgctcctgctgcaccatttcttaaattcttaagtggagtatctgatgtttcattatatttttcaaatgcttcagtagtcatgattgcctcaccatgaacttcaaataaatccccttttgaagtttttaaaggaatagattttattgtcttaacttgagctgttactacctctccagtttcaccatttccccttgtagctgcaatttccattactccgtcttcattataagttaaattaatagtaagcccatcaaacttctttgttattacatatcttaatggcggtaagttttcacctctagaattcatttcatttacaaatttaacatttctattatgccaatctattatttcttcaaaactttgtgctttatctaaactccataatctagctttatgtgtatatttagaaaacccttgtaaagtaacatctccaactctttgggttggtgaataaggaagtacatatcctgtttcttcttctaaagcctttaattcatcatatttactatcatattctttatctgtaactgatggattatctaaagaataatattcataagcatatttatttaaaagttcaactaattcttctatacgagctttcttatccattaaaatcttcctttcttaaatggcaatttataaaatttcaagctttgccatcgataacattaagttctttatcccttgtttatcaaatgcaatagttaattttttatctccattaacatcagcaactgatacaattgttccttctccaaatttattatgtttaacttttcttcccatagttgcttctgctgctgtcattaacgaagatgaactatttgaatttgctaaactatttgttgttgatagaccacttccaccaaagtttctattttcaaatgttccgtaatcacttcttaaactatgtggattactataagttggcttaaatctattagttgaaggtgtcctagctgcaccttgagttaagtctcttgtttctccagtcatagatatatattcccttaattctggcttaatctctgaaatgaagtctgattgagggtatgcaacagttctaccaaatactcttcttacttcagcagatgtcataaataaagtttcttttgctctagttattccaacataacaaagtcttcttgattcttccatttcagcgtcactattaaatgaagcttgacctgggaatattccattttccattccaaccataaatacaaccgggaactctaacccctttgcactatgaattgtcattaatacaactgttccattttcatcttcttcatcttcaagcttatcagtatcttgaacaagcgataccttttctaagtaagattctaattgagttttatttatatcaaaatcagctgctccgcttctcttttctatttcatatgttttttcaaaatcaacagcatctgatactaattcttttaagttttctattctactcttatcttctatttgttttgaagcctcaagttctctaatatatcctgtatcttctaaaattgtctctattaaatgtgatactggaaccgtctcagatatcatcattaaattttccataagctccatgaacttttcaataccagcacaatttctcgctgttagtgttggtatagttctaacctctgataatgcatcccataaagtcaattcataactttcagcaaaatctaaaactttttgtatagttgcatctcctatccctctcttaggaacatttataattcttcttaaagctatactatctgaaggattaacaagaacctttaaataacttaacatatctttaatttcttttctatcatagaacttggttccaccaacaatcttataagctattgcagctcttcttaagctttcttcaaatatacgtgactgagcatttgttctataaagtatagcaaaatctttgtattgtctattttgctctctttttattttttcaatttgattggctacaaaagtcccttcatcaccatctgaaaatgctctatatattttaattttactacctaattcttgttcagttcttagtactttgctttttctatttgcattattaactataacaacattagctgcatttaatatattaccttttgaacgataattttgctcaagctttataaccttagcttctggataatccttctcaaatccaaggatattttttatatctgcgcctctccattggtagatgcattggtcatcatcacccactacgcataaatttctatgtttagctgcaagtaaagttaccaattcatattgagctccattagtatcttgatactcatctaccataatatattggaactttctttgataaaactctaaagtctcaggatcttttttaaataattcaacagtcttacaaattaaatcatcaaaatctaaagcattattttcttttaatcttttttgatacattttataaacttcagcaattttcttttctctaaagtttgattcatgttctctataataagcgtcagcactttgcatattatcttttgctttacttatcttacccattatttcttgttcagtaatttctttatcattaatttgaagaatttttatgcactcttttacaagtgtcttttgatctgttccatcatatatagtaaaattctttttatatccaagcttttcaatttctcttcttaatattctcacacaagtagagtggaatgtagaaatccacatatctttggctttttcaccgataatagcctcaactctttcttgcatttcctttgccgccttattagtaaaagtaatagctaagattttatatggaaagattttaagatcttctatcatatgagccattctataagttaaaactctagtttttcctgagcctgctcctgctaaaataagtacaggtccatccacagttactgcgccttcatattgttctttgtttaataaagattttaaatccaaaagaacatcctcccttcaaaaatatataagtgaaataccttcaaaatcaaatcgaacgtataatctatctaaaaattattatagcataacagtatatattattacctcaaaataaaaatttaattgtacctttatggaaatttttagtttccagaattataataaaaaaataactctacaatcctaaaattgtaaatttaaaaaagaacgcaaaaaaacgcaacccttggggccaggttgcgcttcagcaataagcaataaataaaaagggggctatttaattccttttatttatccttgcattaatattatagtagagaaaaaattatattgcaagggatttttgaaaaatatcttgcttatttttagccccatgaatgttattatatcatttttcgttttctttcgttaaaaactctttaaaatagctaattcctcttctgttaactctctatattcgccttcttctaaatcttcatctaaaggtaaagttccaaattctgttctttttaaatatacaacattcttatcaacagcttcaaacattctcttaacttgatggaattttccttcttgaatagttaccatcacttctgaaccttcatcagtagcattcaaaatttcaagttttgcttctttacataaatatccgtcatccaatgtaattccagccttaaatttagcaacatcttcatcagttactttcttatctatcttcgcataataaaccttatcaaccttccatttaggtgaaatcaatctatgatttagctcaccatcattagttaataataataaccctactgtatccttatctaatcttccaacgggaaatggttcaaacacttggtgatcaatttctaataaatcaacaacagtttcatctctgttatcatatgtagctgaaacaacaccatctggtttgttcatcattaaataaataaattttctataaaatatttcttcaccattaattactattttatctttttcaggatcaacttgcattccactatctttagctatttctccgttaacttcaactaatccacttctacaaattttcttaagctcttttcttgtaccatatcctaaattagacagtaccttatctagtctttccatacaacacctcgttaaactttatatagcctattctattattaatattccacaaatgcaagaaattaaaagaccgcctcaatagaatcttagaaatatgaatattctattgaaacggcatgtcttattttacttcaaactctattatatcataatcttcatatgaaatatctttatggaagctcttagttaatactagaactctataacttccatttttaaatggaacaaatgtatagtaattctttctactataactttgagataatacccattctccatttatcatgatataaaactcatagcaaacttctttcccaccatgtgatgttgcttcaaaagttacttcttgtcctattttaaattcattagaataaagctgtattttagttgagttaactggagttacttcttgaacataaacggaaacttcttttttactatcatactcttcagtagatttcacattcttcgcataaattacaaaagagtattttccaggacatttaggccttatttttattgctttttcttttacaaaatcggtattctctacttcatatccatttatctttgtaacaaatttaactaaaacatccttagtatttttaactattgcttcaatattaataatatcatctactaaataaacctctctactatttaataatacataatcaatatctgctgctatataatcctttgcatctataaataacgatgttgatgcatcatatggtcttgaagaaaattcatccttaactttaatatctatttcatatgttcctgattcagttgggataaaatcaatccaattatttgttccataatctatactttctttttgaattccttctttataaattgtaaacttataaagaggctttattccaccatcagtctttactttaatatttatcttatctccaattatacattttctgcccttatcacatttaacatctgatattctaactggcttttctcctttattaaagacttcatattgaatagatgtaatatcctcatggtctccttcaaatgaaatatccttaacctttagtgttattttatattttccctcatcccttggctcccaaacacactcatttcctctaatatatccactatcttcagaaataggaccttctattatatatctatataataattctcttcctccatcaacatctgcctttaagttaataacagttccagctgcttgtggagatttaacatcacttttaaaacttctaatattaacttcttcataaggatcaacgttatataaaataactgccctatcatcaaagctctttgatgaaaacatatctctcactaaacataataatttatattgccccggaaccttttctttaaatgtgactatacttctagaggaaaaatcttgaatacaaataacttttccctctttattcacttttaaaaatttatataacaatggtctattttgttgataatttgattctaccttaaaaatcaactcttcatttactaacttattatttgttaagcattcaaaattagtaatttctattttatctaactccttaacttctaccttaacagtagtaaagtcatctacatttctttcagagtctaccttcttacattctattaatatttcaaaattaccagcttcaacaccggtaaaagtatattctttttctgtgctatagtctcttagaatttcccaatccttttctccattaatccaaaatctatataatactaattcctcattacatgttacatttattgtagatttttcacctactcttatcttattattaacctctacttcttttatcagtttttcattctctacaacttcatattcggatttaccaagataatcataggattttttacatgaagtggatttaccttgtaccattatcatgtattttcctggcttagagggcttccatgtacatatattgtttttagaaaaatcctgtataggcttccaaatcccttctaatccttctataaatttgtattcaacatcatcattttcagttaaaaatgctgcaatatttatactttcgttcaaatcagcagggcttttattatcaaaatcaattagtacctctttcattttttcttccccctcaccatattatccataattaagttaattactttacatagttttgttgcttcgtcataattttctatttaaattatactctttaccctttgaaataaaaactgaaatttgtctatgaaagtataaaaaaaagaacaactatagatatttttctacagtttattctatattttttctttttattaaatataataaattttttcgtaatctatcgtcatcttctgaagaccttttctttgcattaggtgtctttccaccacctcttcttatcttttgagataaatgcctttgttcaagcatagcacctatattttcattagtataaatatatccctttggactaattgcactagcttttttccctaaacaaatagcggctacaccataatcttgagagattacaatatcattatttaaacattcatttacaactttcatatcaacactctgaaagccactatccacaattctaacttcaccatagcctacatttatataatgattaatatcacaatatattataagctctaacccatatttctttgctatatttacaataatggagataccaggacaggcatctccatcaacaataatcttcatttattatatacctaaaagaaactccttttcctatggacaaaggagtaaattcgccttgccaaatataaaatttggaggcttacttaagtctttcttctagttcagcttttaaatcttcgaatcctggcttaccaagtaaagcaaacatattcttcttgtatgcttcaacacctggttggtcaaatggattaattcctaaaagatatccactgattgcacaagctttttcgaagaagtaaactaattgtccaaagtaatatggtgttaattctggaatatttaaaatcatgttaggaactccaccatcacagtgagctaataatgtccctttgaatgcttgtttattaacgaaatcaactgtcttacctgctaagaagtttaatccatcaacatttccttcagcttcttctatagtaagttcttttgcagctttctccacattaagaactgtttcaaacattattctgctaccatcttgaatgaattgtcccattgaatgtaagtctgttgagaagtcaacagctgctgggaatatacccttttgatccttaccttctgattctccatataattgtttccaccattcattaaaatagtgtaatgaaggttcatagttaactaaaacttctacattttttcctttattgtataatgcatttctcattactgcatattgataacaatcattttcttttaatgatggattagagtatttttctctagcatcagcagctccttgcattaattcatctatattaattccagcaactgcaattggtaataaaccaacagctgttaatactgagaatcttccaccaacatcatcaggaactacgaatgtttcataacccatagtgtcagctaatccttttaatgctcctctttctttatcagtagtagcaaatattctttccttagctccatcaactccatatttcttttccatgaagtctttaaatattctgaaagctatagctggttcagtagttgtaccagatttagatataacattaacagaaacatctaatccttcaatagcttcaaataaatcactaatatatgttgaacttatattgtttcctacgaagaacaccttaggtgtctttcttgcattgtttggtaacatattataaaagttatttgttaatccttctatagcagctcttgcacctaaatatgatccaccaataccaataactattaatacatcagaattttctttaattttattagctgcaaccttaattcttgcaaattcctctttatcgtaatttacaggaagatctaaccaacccaagaaatcatttccaaagccagttccttcgtgaacagttttgtgagcataattaaccataccttccatcttatctaattcagtcaaagatgcatatggttgaacttttgataaatctaaacttaaaccatttttcataatttttcctccgaatattgtggtatttttaacactttttattatatcataatttatcttatgctaacaaatgaaaggtaaattaattaaccctttttatgacattaatcgatattgctttccgtttttttcaatacttaaattcatttttgtaatcttacaccataaattcattattttttatagaaattaataaaatatttcttattaactcttatcaatacatatatattatattcataaatataattagattattcacttaaataattaacaatagtttgtatactttgatcatctaatgcttttgccttacctatagttccaccaagttttgtccatacataattatgaacttctacaccattagaaaaatctaattctttccatttctttaattctgtatcaagatattcatctctaccatttagctgatataaagctttatctatgctatcttgagttatttcatcttttccccatatgtttccgtcctcagctattattatagtatttgccatacgatgaatcatatcatatattgtattaatatcaacaacttcagtcgtaatattttcttctgtattaccaatactttcttctgtgttttctacttcattatttgattcacttaccttattcaaagcaaaattaactatttcatatccatttacccataaaatggcaacagttgaaagtgataagattaaaataactataattattatagctttttttgctttagaatttcctccctcatactcatactcatcttcatcatagtcatctttatatttcttttcatcaatagttttaaactcttctaatttttcttcatctttcttttctatcttatcttttcccataccagtactcctttcattcctctcttaaccatatacttaaatcattatcaatatattaataaaatactttttatttaattacccatactctgaatctcttctattttagagtttactccatcaataaattcctcaaagcaaattcctctttccataatatctttagctatatcagtatctccaatatatctaaaatgccatggttcataattatatcctgtaatatcttcctttcctttttgatatctaaggataaaaccatacttataacaattgttaattaaccatttaaatgcatcagtattttcaaacccttcatctaagtaaggataatcattacaaactatatcaattgctaatcccgtctgatgttctgatgctcctggatcagctgtatattgtctagttttttcaattccttttgcttctactcttgaattatataaattctcttgcacactataacttctatatcctgaaatagctataaggttaacattatcttttaatgctgcattaaacatttcctttgctgcattgtttgtcctttcatctaactgcttacaatcaatgtattcttcaaaagctatatctgaatctaccaaagtactaggcacataatcaacagcaagcttattatttttatttactaatataaataattcatcatttaatatatcttgtaatcttttaatttcgtcatttttcaaattatcagcatctgaactaaaggcatcattcatttctctgctcttagattttgctaataaaacttctttattatttacatcttctacactttcactactatctatattattatcacttacgttattaattcctaatgcaactgcaacaactataaatatcaaacaggacattatttttaatttatcaaattcctttctattattcatatcatcctcctactatattaatgatattggtatatattgccataacatttactataataatacttttcatagtttttttctagtaattttctaaaaaagcagataagattttgtcctatctgctttataattatcatagtaaaaattatgtctattattaaattttagcatacctctattgttaaattttaacacaaattaattgtttttaccatatcttttaatattgtcaatgaaaaaactcggaatgctcaataaaaacatcccgagatttctgtttattattcgaattcaatagctactaagggttttcctatgtaatcataaagtacgcgattaacacctttaaccttatttactattctagttgttaatttttcaagtacttcacatggaaaatcagttgattctccgtaaagtattcattagtaaatatgttaatactatttttatgaacctaaaacactagtaatgattaatcattactagtgttttttttactattatattaaatttcaaataatatcttactttaattcaggccataaacctttattagctgcgtataattcatctaacacttttttacccacagtataattaggtattgttttgttaagcattacagcttctaaagctttttggtaagatccagataacgctgcttcaaccgttattttttcataagctttttgcatttccatcaatcctttttggaaatctggtacctcaccaatattaatggtttcagctcccattgaaccaatataggctggcgtctcaacaaccgcctctgagtcaaaatttgagattgcaccatgattctttttattgactataaatcgctctctagtattatgaataatcgcataagcaatatcaacaatataattgccatgaacgcctgcatgtagtgaagattctttagctgatccttctgaaatcactcgacggcattcatcataaatacgtttttccctaccttgcattacataatctccacgagtaaaggaaacgtcatcatgcgccaccatttcatctggtgttaaataatactgcaagtaacaattagggaaatattccggaaaacgtttaaataagctaatcatttgtttataagtatccacccaatactgatctccaacagtttcatcatttgacatcaaaagcgtatcaattttaccagaaagaacatcttcacgtaattgcggtaataaatcaaaacccttttcatcatatacattgctccaccaaccaaaatgattcaatccaaagtatttaaatgttaaatcatggtgatccttattaaagtactttgcaatggccccttcaattgaaattggcatatcacaaatgcataaaacattcgcttccggaaactcacgataaattgcttctgataaaatggcctctggatttgtatagtttaaaatccaagctttaggacaaatttcttttaccttttttataatttctagaacagctggtattaccctcatagcaaaagagaatccacctaagccacaagtttcctgaccaacaacgccattatttaagcatattttttcatcaatagctcgctgtttattcaagccgggacgaatttgcataaataagaaattagcaccttttaaagcttcatcaatattcgttgtataagtaacatttactttagatcctaattctttatagtacattttggtatattgaccaagcaaggaaactctttcctcatcaatatcatatagaaccaaatcgctcaagtttaattcttctgcacgctttcttaaaacttctaaaataccaggtgattgcgtagaaccgccaccaaccattacaaatttattacccattttctacttccctccaatttctaaaaattaaacctcattttattcatgtacttttttgagatattccatataagcttcaactttttcgcgttcttgttccacaccaataccaatgattatttgtatgtgtttacctttatcaacgattccagaagcccttacattttcttttaatattttaatattaactttatcttcatctttaacatcaacacgtaatcttgtgtagcaattaattatgttttcaatattatctgcaccacctaagccggcaacgatattttgaatttgtggttcaaactctgaatcaggatcacctacactcaaatcagtaactggctcacttacaacttcatctatttcacgacctaatgttggaatatttaatttcacaattaattttttgaacacaaaatattctaaaacagcagttgcaataaagattactggaattaaatattgatgccctaaacgtgttggaaatgcaaaactattgataatcatatttattcctgtatcaaactggatattaatccctactaaatttgtaataaataaactcaatccatatactacagcatgtgccaaccataaaatgggtgataagaacaagaataaaaattctaatggttcagtaacaccagccaagaacgctgtaattacagttggaattagaatcgtagcaaccttctttctattttctggacgtgctgttttccaaagcgcaaatgcaatacctattggtaaagaaatcgaaccaaagtttgataaataacctatcgatggatgcattgttgtgatttgacttacattccctagttctgctaaccagatattgaatgcaccgttatatacttgacctgcaatttctgcggtaccaccaagcggggtataaaaaatcggcatccataaaaagtggtgcaaccctaacggtaaaagtaaacgatttaagaacccatagaagaaaaaacctactgatcctgcagttgtagttgtttttactactgcttcaactactgagttaatgattggccaaacataagtaatccctattgcaagcagaatcgttgcaaatacaataagtatataaacagactttgtaccagaatatggtgacaaatacctgtgtagcttaatatcaccgaatttattgaccatccaaccgacgaacacccctaaagaaattcctagaaaaactcccatatctgttacttggataccaaagaccattccttgtccagtcccataaagcccttgttcaccagcaacagccaaacgatccgtaattgttaaccaagaattattggcgtataaaaagattaaaaacgtaataattcctaaaattgccgcatccgttttatactttggttttgctaatgctgtggcaacccctacacaaaatatagcacttagctgaccaatcatccccccagataaaatattaaagataaaatctccaatattttttgttaaatttggcatcatttctagtttcaaaattgcacaaactgacaaaatgattccggtcaccgccataaacattactggctgaataatcgcttttgaaaaaacactggccgatttaataaacttctctttcatatatgtctctcccttttaatatttttaatttaattattccaactaaaaaagtttctacccaataaatatttatatatttttataactacatgtcacaatctgattacattcaaatagttgcttcatttgtgagtcacacaaaattgatacttccttcatccgttgaatattaaatgaagaattgaaatacagcatctcatctacataagctggatgaaccatcagctctgttatccaattatctttaacttgatcaagcactgtttgaacttcctcgaaacattttattcggttttcttcaaaagatatcgttaaatcgcgaatagctgaatggttcatcaaatctagaaaccctttaattcccttctgagcaggtagctctatattttcttctaacccaaaaacatttcgaaaacacaaatgatatttatctgcaattcttttagttatcttcaaattttcaggaaatgtatgaacatgatgatgactatccaaatgcgtcaacttaagtccgtgatccattaaataatctatttgatgggaccactcctgaaaaatttcttcatcacaaatttcattacgatgttttttatattcagataagctataaaagtctccattttcatctattagtgaagcccctttggttaatggttttccacaggttaaaacaagatgaccacccactccaagatatgggttttccttagcaagcgtaatagcttcatcacatcctggcatattagccattaaagttgtcgaggtcagaattccttccttatgagatttgatgattcctagattgactgctgaagagtagccaaaatcatcggcgttgataattacttttttcataatctacctctttcattaaatcatattagcattactcttcttaactctagaaaatacaataagtttaactagacgtatttatcccatacgaaagaagaaacgagtaatgaacaaaacaaatattagatgtcctcatcgtcactacgataaactatacaaatttgattttgataatccggataatcaaaaataaccaaacttatataattttcaaagatcgataaactctaaattttattaaactattttttggtaatatcttaacggagtaattaaagaaactatattcatacaattgtatttgctttctttatattaatagtatattatataaaaaaagcgcaaacaatgcttatacactatcatggttacgttttcactttttgaatatactttcacaggagcgtgagattatgaccaaaatttactatttaaatcgtttatttcctaaaaataattttcgaaatgaagatgaaaaaataatcgagaacattattgaagcaattaaaaataaatctgtaatcgacattcgtactattgcacaaatgaactacacctctcaatcttcaatcagtcgtttagcaaaaagagcaggctttaataatttcaaagagctaatttttttcctttcaaatgaattatcatataaattgacaaatcaattagaaacattaccttttgtgatggtaaaccaagattgggatcaaatagatagctattttaataatgctttctcaaataaaaaaatatacttgtttggtgaaggattttgccaaatattagttgattacacttatcgtaaattacttttaaaaagaatttatgctattgacttaaatggcgtggaaatcagtttggtatcagatcaaaccccttatacattaattacattttcccaatcaggtgaaaataaaaacggtttaataaaaatggaagagtgtaagcattatggtggtaaagttattgcctttacagctacggaaaatagtagctacactacgaaaagtgatcttgcattcattatagaaaatggctctactggtatagatcatgaaaatcaaaatttgaattacttttttggtaactctttaaatttgatggagcatctcattaatcgttatgcaaaatcaatatcaactcattgataaaaacttctccacaaaaaaatatcaccaagaaagttcatatttatgactttctcggtgatttatattattcaaattcaatagttgcaggtggctttcctgtacaatcatacattactctatttacaccattaacttcatttactattctagtagttacttttccaagaacttcccatggtaaatcagcagattctgctgtcataaagtcacttgtagttacagctcttaaagcaattgcataatcataagttctttcatcacccataactcctacagatctcatattagttaaagctgcaaaatattgaccaatttctttatcaattccagctttagctatttcttctctgtaaatggcatctgcatcttgaactattcttaccttttcagcagttacttcaccaataattctaataccaagtcctggacctgggaatggttgtctgtacactaaatgttcaggtatattaagctctaaaccggcctttctaacctcatctttaaataataatcttaatggttcgattatttctttaaaatcaacgtaatcaggaagtcctccaacattgtggtgagacttaattacagctgaatcccctaatccactttcaattatatctggataaattgtaccttgaactaagaagtccacagctccaattttcttagcttcttcttcaaatactctaatgaattcttcacctatgatttttctcttagtttctggatcttctactccagcaagagcttcatagaatctttcttgagcattaactctgataaagtttaagtcatattgtccttcaggtccaaatatagcttctacttcatcaccttcattttttctaagtagaccatggtcaacaaatacacaagttaattgctttccaatagcttttgataataaaacagctgcaacagatgaatcaactccacctgataatgcacataatgctttaccatctcctactttttctcttatttcttcaattgtcttctcaacaaatgaatccattttccaatccccagaacacttacaaatgttataaacaaagtttgataacatcttagttccttcttgagtatgcataacttctggatggaattgaactgcataaagattcttttcttcacattccatagcagccactgggcaaactggagtatgacctataattttgaatccttctggagctctttctatataatcagtatggctcatccaacaaatcgttgatgatgcaacaccttcaaataattttgattcaacatcaacagcaacttctgtcttaccatactcacttacaggagcagtagcaacctttcctccaagtacatgagacataagttgtgaaccatagcaaataccaagtacaggtatccctaattcaaatatagctttatcacataaaggagaattttcaccatatacactatttggtcctccagtgaaaatgattccctttggattcatttctcttattttttcaacgcttaaattataaggatgaacctcacaatatacattacactctctaactcttcttgcaattaattgattatattgaccaccaaagtcaagtattaatactaattctctactcattagaatcctcctaatgttttttctttaattatctcgtaaaattatacatttttcaacaaaaatgttaaaacctaaactcagaaactccaaaaaggagtttccatatctaattattaactcaaaactattaattattaactatctaacctattccctaacactataatttggtgcttctttagtgatatttatatcatgtggatgactttctcttatccctgatgcagtttgaacaacaaatcctgcattttcatataaatcttctaaagttggagccccaaggtatcccatacctgatcttattcccccaattaattgatataaagtctcagctaccatacccttatatgcaactcttccttcaacaccttctggaacaaatttcttagtaccattttggaaatatctatccgaagaacccttttccatagctcctaaagaacccattcctctataaactttatagcttcttccttgatatatttccatttcacctggtgcttcatcacaaccagcaagcattgatcccatcatacaagcacaagccccaccagctaaagccttaactatatctcctgaatatttaagtccaccatcagcgattactggaactccatactttcttccttcttcagcgcaatccataactgcagttaattgaggaacccctaccccagcaactattcttgttgtacagattgatcctggtccaataccaacttttatacagtcagctccagcttctgctaaatctcttgtagcctctgcagtagcaacatttccagcaattatttgaagttcaggatatttagcttttatctttttaacaccctcaataactccttttgagtgaccgtgagctgtatctaatgtaataacgtcaacctgtgccttaactaaagcatcaactctttccatcatatcattagtaattccaactgatgctccacaaagaagtcttcctcttgaatcttttgctgcatttggatatgccctaactttttctatatcttttattgttataagcccttttaggttattttctgaatcaactaaaggtaatttttctattttatgagtctttaatatttctaaagcttcttctaatgttgttccttctgaagctgttactaatggactcttagtcataacttctgaaatctctttatcatagtttgtttcgaatactatgtctctgttagttataattcctactaattgagttcctcttgtaactggaacacctgagattctatattgagccattaaatctaatgcttctcttacagtatggtcttcatttaagaatattggatctgtgattactccattttcttgtctcttaactctatcaacttcttttgcttgatcttcaattgtcatgtttttgtgtattattccgattccgccttctctagccattgcaattgccatcttagattcagtaactgtatccatacttgcactcattagcggtatgtttaatgttattgtttttgttaattgagtttttaatgaaacctgatttggtaaaacctctgatttgtttggtactagtaatacatcatcaaatgtgtaagctgtttttaatattcttgccatacttaatctctcctatcattattattcatctttatatttatgtaataaatgccctttatatctgattatatattttgttggggctaatcaaataaaaaaaagcatattaagtccgctatctataagtgaacattaatatgcttttatcctgcacattattcgtgtttaggtaagtatatcaaattcactcatagatgaaaatttaaggttttcagtagaaacaccctgccatattcagggtttatatgagttgttttattattcgtgttttttcgctttttattattatagtttatggcttatagcttgtcaatataataaatcaaaacaaataaatgctaataatatatttactatctttatgatatattattagcatttataaatatcttattatctataatttattattttattaatagttgtttttattttatgataaattatcatttcaatcgctataaatcccaaatatattattaattaaaataacgcactaatataatattcttaatttatatatccgtaaacaatttaatctcaaaaaagcaagctaaattataacctagcttgcttttttataaacttaatatttaattttaatataaatctggaagcttagttccaactgtatatacttttacatcttcacttagttgaccaattgttaccttattataatattgctatgttacctaatctacacttattatttgaagctattgctacctcctctagtaaaaaagcattactactatactaataattatcacttcataataattacttatattgttcattataattagtatttttacatatttaatcataatattgtttattattatccaattgaactttcttttaaaataattttagataaaaatctattatgctattaccatataagcaagcaattaatcctccaattgctaagtatggtccaaaggcaatttctgctttcttatcttttaactttaaaactaatattcctgtagcaactaatccacctaaaactactgaaatgaataaagttactaaaacgcccttaattcctaaaaataatccgcatataagagcaatatcaatatcaccctcacccattccatgagttaaaattacaattaaataaataactaaaaatccaataaaggcaccagtaatataattccatggtataactcttgtttctaaccactccaatcctagaaatattaatcctgaaactaccccaaaaacaatagtagagttatatacatttttagtttgaagatctattattcctattactatcaaaagagaggctaataagcagaacttaaataaatttaaggtaaatccaaattttaaataaattgctacatataaaattgaatttaatatttcaactattggatattgtatagaaatcttttctttacatcctctacatattccacctaataatacataacttaatactggaattaagtctttcacccttaattcatacccacaattagtacaatgtgatggtggaaatgcaattgattcttcatttgctattctacaaatacatacgtttaaaaaacttcctattactaatccaaagattattactaaaaaaatctccattactactccttaaaattaaattgtaattttatcatcattagaataaataattacaatcaacaccaattagttatatgatagcattttttactactatattccatgtttcattttactccttttatttttttgtattttcctacaaagaaattatttttttgtaattatatccataagctgcaataaaaataaggttactattaactccttattatagttaataataaccttatttattaaaattactaatttttattcattatttatattagtacattccatccattccgcccattcctggtgctcctggcattggctgttctttttctggaatatcaaccacagcagcttcagtagttaagaatgtagaagctacagatgcagcattttgaagtgcacttcttgtaaccttagttggatcaactattccagtcttaatcatatttacatattcatcatgtaaagcatcatatcccattccagcttcgctgttcttgattctttcaataattacagaaccttcaacacctgcattagtagcaatttgtctcattggctcttctaatgctcttactataatgttaataccaacttgagtatcagcaacgtctgattttaactctgcaactttgttaataacattaacgtaagctgttccaccacctggtactattccttcttcaactgcagccttagtagcagctaaagcatcttctattctaagctttctttccttaagttctgtttctgtagcagcaccaactttaattactgcaacaccaccagaaagtttagctaatctttcttgtaatttttctttatcaaattcagaagtagtttcttctatttgcatttttatttgattgattctttcttttatattagcgctgtctcctctaccatttactatagtagtattatccttagaaattttaacactttcagcttgacctagcatatctaaagtagtttcttttaaatctcttcctaactcttcagaaattacttgaccaccagttaaaatagctatatcttgaagcatttcttttcttctatctccaaaccctggagctttaaccgcaacacagttaaatgttcctcttaacttattaactactaatgtagccattgcttcaccttcaatatcttcagctattattaatagcttcttaccagcttgaactatttgctctaatactggtaatatttcttgtatgtttgtaatcttcttatcagttattaaaattagtggattatccaatatagcttccatcttttcagtatcagttaccatataagctgaaacatatcctctatcaaattgcataccttcaactacttctagttcagtacccattgatttagattcttcaacagtaataacgccttcatttcctaccttttccatagcatctgaaataagcttacctatttcttcatcagctgcagaaatagctgcaactctagctatatcttctttcccactaactggtttagaaatctctaatatttcactaactgccttttcaacagcttttcttataccatttctaagtaacattggatttgcaccagctgttacattttttaatccttctcttataatagcttgagctaaaagagtagctgttgtagtaccatcccctgcaacatcattagttttagttgcaacttcctttactaactgagctcccatattttcatacggatcttctaattctatttctcttgcaattgaaacaccatcatttgttataagtggtgaaccaaatttcttatctaaaactacatttcttccttttggtcctaatgttacctttaccgtatcagctaatttatcaacaccaatttgcattgctcttctagcttcttctccaaattgaatcatctttgccataataaatctacctcctaattaattattctactattgctaatatatcgtcttgttttaatataatatattcttcaccttcaaccttcacgtctgttcctgcatacttagaatataataccttatttccaacttctacatccataggaattctctttccctcaaccattgctcctggccctattgcaacaacttctgcttcttgtggctgttcctttgctgttcctgttaaaagtattccactctttgtagttgtttcagcttctaatttttttattactactctatcacctaatggttttatattcataaataaaccctcctatatttttattattagcactcacctaaacagagtgctaatatctttatatttataatataatttataaagtaaactttcaacaattactttctatattattaccttactaaggtcaaatattactaattatagtaatttatttttaatttactttgtttcccattatttttcttattatttaaactttaattgaatcacatttactattttaacataaaataccattctttgaaacaagctatgaatttatcatactatagataaccccacagttatatctaataatttatttacatgttaaaaaccttgtatcaaactcttacactatatattattgctcttcagaaggcattctttctaaatttactccttcaaaatcctcaagagttctatttttaagaacagccttaatagtagttccattattaatcttagtaaatgcagccttagctctcattggtggagcaattacaccggcgccattgatacatccaccttcacacatcataccttcaatgaagtttccaggtaacttgcctacctttgcaagcatcatagtctttttacaatcaagtcctgatgttggtactggtttaaactcaacttcaactctactatctgaaatataatttttaatagctgcagttaatccacctgaagcaccaaaatttcttccaaatacagatgcatcattaacattttcctcttcacattcaaaaggattaacatcaaaagcttcgaataaagcaagcaactcttcaaatgttaaaacataatcaactgcatcctctactccaattctaacagcctcgctctttttagctgtacaaggtcctatgaatacaaccttagcctctggatcagttttctttatatatcttgctgctgcaaccattggcgatacagttcctgaaattctatccttttcagtaggatttactttttcaataaagttcaagaaacctggacaacaggagttggtcatatatttatctcctctttccattctttcaacaaattcatttgcttcatgaacagttactgcatcagcacctaatgcagcctcaatcatttcttcaaatccaagcgctcttatagcatttctaatcttaccgtaattcatcgtaggtccaaactgtccagttatagctggtgcaacaattgcatacatttttctttttcttgaaagcctctttgcaactggaacaattaagctcttatcagaaattgctccaaaaggacatgctctcatacatgaaccacaattaacacataattcctctttaatcatagctcgtctatcatcaggattaatatctaaagctcctgtcggacatgatctcttacaaggtctcataacctctgatatagcatcataaggacatgcttttttacatcctccacattccttacataactcttgatttatataagctcttccatttactattgtaatagctccaaaattacatgcactttgacatctatgtgcaagacaatttctacatgaatctgttacattgaatttatttatagggcatctatcgcatgctgcttctataacatatataatttgctcatctggtctaatatcaattaaatctggttcagcattatcgccattagcaagatatcctgcagcaagcttagctctttctaaaacgatagctctttctttataaacacaacatctatattgtgcaatttcacctttaataacttcataaggaaccttttcaatactctctaaactaatttcatcattttttgcaagccttgcaacttctgttaatacctcatgctttaactttttaagctgagtttcaaatttaaacatttaaccactcccccctcacactgtataccacttctaattatacaatattttcccaataacttcttttctttttcgaatattctgataatattttttcatatttaaagttcaacatttatcatcaaaatcacatttaatcttatttttttataaattaatttctaaatttacttataaaaaatgataggatttccttttacaaatcaatcctatcacttctttaaaacaacttaatcaatatacttaatcaattataaaaaacttcaatattaatatattttttcatcagtctttattataaaatcaactaatgcctctttaatatcatcaattaattcaacatctacaattgacatattatcatcatcagtatgaacaactcctgtaataccatcttggcctattaccaatgaagcagcattttctcttctaaatgacatatgatcgctacttcctacaactgcgccttcttcattcatcgcataaggaaccatttcataataaacatcatcttcatctaaaacttcaataaaatcatcatataattcttgagatgcaggatcattatttttaactgccaatccttcatttcctctaatcccaacacaatcaatattaatgttataccaatcatcatatgattctttaaattcacttacaaactttctactacctattaatccaagctcttcagcattaaatgcagcaaaaattatatcatatggtggtttttcataactataatgattagccaattccttagcactctcaagtaaaactgcaacaccagatgcattatcaattgcgccttctattttactaacactaatttgttgtgaatcggtgttgctggctgcttcttgatttttctttcttactgttacatggtcaaagtgagctgaaattacaatagccttagaactatcatcacctttaataactccaattacattatcaacttcattttcattatctccagctggattaaatatagatctcatttctttatttaactcaaccttttcaaagtaacttccattattaaatggctctaacccaattgactcataataatttttaataaactccgctgatttagtattttcatcagttcctactactcttgacaaatattcatcactagtaagttcattcatgatactttcaatatttagatcttccggattttttcctgcttcattatatgaaccttgttcttctgttaatatccctttactaaatacactttgcttaaaactacttccacatccagtaaaaagtaagcttaccactaatgcactagatattattgatattaatctcttctttgtatacatagtaacctcccataaaactattaagtttttatcatttccccttagcttatccctcttataccaattctatacataactttagttactactctacctttatattattttctcttgcataataaaataaatattgctgagccatacctgataactctccaaatttatctcttccaaatactcttattttatttaatgatacatctggcgccaaatagaaatgtatcattgctctttttatccaaacatcaactgggaaggctgattttttacccattgagaaaagcattatacaatctgcaaccttagctccaacccccataaagttttgaagtgccttatgacattcatcagttggcaatgactttatatattctaaatcaaattgttttaattcttcatttaaagttccattgttcttagcatcaattgcatcatttaccttacctatagtatctactatgtatttacttctaaaagatgctcctgtttcttttatttcttccagtgttactttctttaattgttctggcgttggaaatgcataatatatatttcctttatactctattttatctccccatctttcagatatctttttaatagtcttcattattgatggaatactatttcttgctgatattatgaaacttattaacatttcaaaaggatcttgatttagtatccttataccatacccaaattcaacactttttcttaaaagttcatctttagataactcttcttttatttctccatagttaacctctaaatcaaagtactctttccatatttcattaaagtctttcatattagtattaagtattgttactgtgcttccttcttgaattacttctataactcttctataagcaacaattatgtaatctgtatcagttattctttcccatctaaaacattgaccacactctaatatttgttttatattaaaatccttcacattttctaatattattgaattttctttttctgttatatttgtatagttcattttcacacctcgttactataataagctttaaatcttatcatttatatttttattgtttctaacttaatatttttatattctaaagataaatattattatttaataatttatatctattatgctatattaaataactttatttttcaatatatttcaaaatactctaaaaatatataggcataataaaaactaaatataatataggaaattaatttattaaattattaataagccattatagttaaaataacaaaactataatggcttatatgatatcccaaattaatataatttatattctattaattgttttctttttctatctattaattgaataagactccttataatcctcaattatttcttgtaatacttcagctgacactatcatcatttttgaacatcttgtttcatttttatagtatttttcttttaaagttatacaatctaatgaattcattcttttattaaattcatacaaaaatttagaggtcatttctttaatatgaggacttttatgtcctctttctgtagtgaacattatccccagtactgctatagctcctgttgctgcaccacagatactccctattgccattccccctccaaatgatgccattgtcattaaagtttgctttgaaatatttaaatcataaacttcgttagctgctacaagcatacattctgcacaatttaaatcatactttttatcataatatttaattgtagtttctaataacattaatttttttctccttatagttaccactttcattagttatttacttataaagttacatattcatttataacattaaaaaccttcttaagtaactgatccatattcttacctcttagaaaattcatttcgatttctattccaccagttaaaaataactttatttctgaatccatatcaaagtgtcctgctgtttctattgcataagtaactattttgctatacggaattgcataatactctgttttcttaccagttatcccttgtttatcacatattaaaatctttttatctgtaaataaagctgcatctctaacagtctttactgcaaataatggattctcatttctacttacaaaagaaagtaccgattttggtatctctacttcaccataaaaattaaatactcttttgttattagtttgatcttccatgtattaacctcactccttttactatactcatattataaattgaatcattaacttaagatggacttttaactacatctcaaggttagaattcattatccccaatggcccctaatctaagcgtgtaccttatgtaacacttcaccctaaaaatatgaaaatattacagaacttctaaccatcatataaatatctctttataaatcttagtactttattatgataattataccataatacaataaagggcaactacccgtcgatagttgccttttaaagttaaattaaaacgctcattttttaatatattgtttttcaaatatactgtatctttttaaatatattaatttttttaaatttataattactataatattaattaaacattatagttatagaatcctcttcctgtttttctacctaaccatcctgctctaacatactttcttaaaatactactagctctgtatttattatctccagtttcattatataaaacatccataatagctaaacaaacatctaatccaattaaatctcctaaagctaaaggtcccattgggtgatttgcaccatatttcatagctgtatctatgtcttctactgatgcaattccttcttgaagaataaatgaagcctcattaatcattggaataagtattctattaactacaaatcctggggcttctgcaacttctactggttctttaccaattgctaaagataattctttaacagcatcaaaagtttcttgagaagtagccatacctctgataatttcaacaagcttcattactggagctggattaaagaagtgcattcctataaccttttctggtctaccagttactgaagcaacttctgttattgataaagaagatgtatttgaagctaaaatagtttctggcttacatatcttatctaactcagcaaatatttctttcttaattttcatattttcaattgcagcttcaacaactaagtcgcagtctgcagctaaattcatatcagtagttcctgaaattcttgataaaatatcttccttagtttcttcagtcatttttcccttagcaactaatttagataaacccttatttattccagcaagccctttttcaacgaattcatcctttatatctctaactataacttcatatcctttttgagcaaaagcttgaactattccagcgcccatagttcctgcacctaaaacaaaaatcttttccatatctgaacctctccccttttaaacagtaccaagtgataaatatcaagttattatatgaacatttgctcaccaacttcacttgtttctgtaattatttaattctcaatttttttaacccatagtttctttatttcatccatattatttttattaaagtaaaaatcctaggctattttactttacatactattataaaaatataattggccatttatattttcataattttaatatttatatatttgtatttttccttaaataaactacctaaacaaaattatattttgcacactaatgtttcttcagaatcagcagattcttttaatttatttatcatttctggaataactttatttaaatctccaactattgcatagtctgcaactttcattattggagcagtttcatctttatttatagcaattatcatatctgattcttgcatacctgcaacgtgttggattgctcctgaaataccacaagcaacataaattgtaggccttacagttttaccagtttgtccaacttgataatctctttcaatccatcctttatctacagcacctcttgatgctccaacaactccacctaaaactgttgctaattcttgtaaaagtgcgaagttttctttacttccaactcctctacctccagcaactataactttagcttctccaatatctacaatatccttattagccttaactacttcaacaacagtagttctaatatctgatttttctaattcaacagaaacattttctattatatagttttctttcttttcagttaatttagagaatactcctggtcttactgtagccatttgtggtctgtgatttggacacgcaatagttgccattaagttaccaccaaatgcaggtcttgttgcaagtaagtcaccattagtaacatctacttctaaagatgtacagtctgcagttaatccagttgaaagtctagctgcaactcttggccctaaatctctacctacaaaagtagcccctataaataatattcctggctttctttcatttgctaactcacaaattacttttgtatatccatcagttgtataattttctaatgcttcatgttcagctactaatatttcatctgcaccatgttctcctaaaatatctgctaaacaagcaacgttatttcctaataatacagcagtaagcttaactcctaattcatcagctaatcttctaccttctcctaatatttctaatgaaaccttttgtaattcaccatttctttgttcagcgaatacccaaacgccattatattctgatatattcatctccaattatcctcctattatcttagatgtagtgtttttcttttaactttcctaaaacatatgctactgcctctggagctgattctttaacaatttctcctgcacctttagcttctttagtcatagacttcttaacctttgttggagaaccttttaatccaagttcttcaactggtatatcaaggtctgctgcagtcataactttcacttctttatctactgtatcgaagatatattgaacattcatatatcttggatgatttaattcttcaattgcagttaaaagtactggagtttgaacctttattaattcatatccatcttctaatgctctatttactaataatccatcttcttcaactgtaacaccttgtacatatgttacttgtggaactcctaaatgctctgctatttctggaccaacttgtgcagtatcaccatcaatggcttgtcttccgccaaaaattatatcgtaatctaattctttaattgctgctgcaatagtctttgaagttgctaatgtgtcagctcccccaaatgctctatctgttaaaagaatagcttcatcagctcccatgcataaagcttctcttaatgcattttttgcttgaggaggtcccatactaactacagttacatgcgctccatagttttcttttaattgtaaagctgcttctaaagcatgcttatcttccggatttattattgaaggaacaccatctcttataagagtccctgtttttggatctatttttacaactgttgtgtctggtacttgttttaaacaaactactatattcattattaaaagcctccctctatcttaatgcagcgcctgagataaccatcttttgaacttcagaagttccttcatagatttcagttatcttagcatctctcatcattctttcaactggatattccttagtatatccatatccaccatgaatttgaacagccttagttgttacctccatagcaacttcagcagcaaataattttgccttagcggcatctactgaatatggaagcttgttttgtttaagccatgcagctttgtatactaataacttagcagcgtcaatctttgtttccatttcagcaatcatccattgtaatccttggaatgctgataaaggtctgccaaattgttttctttctttcatatatttaacagattcttcataagctccttctgcaattcctaaagcctgagcagctataccaattcttcctccatcaagagttttcattgctataccaaaccccttaccttctcttccaattaaattttcttttggaactatgcagttttcaaatataagctctgttgtagaagatgctctaattcctaacttatcttcttttttaccaattgagaatccagggaagtctttttcaactatgaaagcagatatgcctctagttccttgagacttatctgtcattgcaaatactatgaaagtatctgctactccaccattagtaataaatatcttagatccatttaaaatatagttatctccatctaaaattgctgtagtttgttgtcctgcagcatctgtccctgctcctggttcagttaaaccaaatgcacctatcttctcaccttttgcaagtggaactaagtatttttccttttgtgccggtgttccattttcatataataatgaagcacaaagtgaagtatgagctgaaagaataactccagttgttccgcaaacctttgataactcttcaacagctatgatatatgataatacatctccgccagcgccacctaactctttaggaaatggtattcccatcatacctagttctgccattttctttacattttccattggaaatctttctgtttcatcaatttcagcagctattggttttacttcattaactgcaaattctctaaccatttgccttactaactcttgttctctagttaatccaaaattcattgcttttttacctccctgcaataccctgtttatgtgtataattacactcaaatatgtaaaatacacttagcttatatatttaaattttattaaataacaccctttttatatttaatagtttaggtttaaatgcctaattgagtttcttaaaatataattttcaaattcgtcatagccctaatttattccttaactattaactaactcctagttcttaactatttttaaagttcttttctcttctttctaagaaagcactcattccctcaacttgatcttctgaatcaaagcattttccaaaatcatttgcttctattgcaattgctttatctatatcaacttgcattcctctattaatagcatctttacaatacttaactgctattggtgcatttgcacaaataactgaagccatttttcttgcttcttccattaagttttctaatggaacaaccttattaactaaaccaattcttaaagcttcatcagccttaatcatcgcacaagtataaatcatttctttggctttacctaatccaactattctaggcaatctttgagttcccccaaaacctggtgtaattccaagtcctgcttctggttgggcaaactttgctttttctgaagcaattcttatatcgcaagccattgcaagttcacatcctccacctaaagcaaatccagatattgctgctataacaggtttgtctaaattttctattcttctaaacaccttatttcctaacagtccaaactcttctccacccttagcatctaaatctttcatttcagcgatgtctgctcctgctacgaaagatttttcacctgccccagttaatattacacaataaacattactatcttcctcaatgttagaaatagctaggtctaattctcttaatgtatcagaatttaaagcatttaatgccttaggtctatttattgtaactattgctaagttcccatctttttcaagagtcacatttttcaactcttcttctaaaattacatttttgattttcataaatccttcctccctttttataccataatccctcataaacaccctactctttgttacataattaacaaagaattataaaaaaactctctttcacccttttctttggttagaagattctgaataatcacaacctatttataattataatatctaaatttatcatttgcaattaatatttacctttttggtatattaattccactttttcaatgtttttcttagtatacgtttactatttgaattttattttatttgttgatttgttaacatgaaaaaaaaatcatataaaccatatgattgttattaattaaaccttaaattagaaagttatctattttttataaaaataaaaatagcaactcaaaattatattcttcataaaacctcttttgaatttgctatttattctaaactattaaattattttattcatctttcattaaatacactaatgttaataaactttcagaaagatgaacattttcaaccttaacatcctctggtacaactaaatcaacaggtgcaaaattccatattccttttattccaccctttactaaaagatcagaaaccttttgtgcattaattctaggtacgcaaataattccaatattaatatcattattttctaaataattatttaatgtatcaatatccattatttctacatctctaattttcattccaataagctttggattagcatcaaatatagcatcaatagataaccctaattcagaaaatctactataatttgcaattgcttgccctaagttaccagcaccaataatgattccagtataatctttatctaatcctaaaattaaactaatttgtttatataattctttaacattatatccgtatccttgttgtccaaagtcaccaaaattatttaaatcttgtctaatttgagatgctgtaaatcctattttttcacctaattcctttgatgaaattctatctacatcatttctcatcaactctttcaaatatctatggtactttggtaatcttttaattactgccatagagacacttttctttttttccatagtatatgaatctccttaatttatttcaataatttccctattcatttcaactttgataatataataacatactttcaacattttttctattaatttaataattattaaaatcttttattcatatttcattttttattttatttaattatattaatattatatcaacaaatcatataataagattttcatttctcatttattattttcacctaaaaacagagacttatgtataacgtagcagatgcgttatacataagtctcatgcagcataatatcagattttaacacctctgatattgaaacaaggatcaaagtgatcttgtatgccattcccttttgcctaaaattttctggacttattatattataattaaagctttattgtttgtcaatatttatcgaattatcctcattgaatttaatactgcaagtaatgttaccccaacatctgcaaatacagctgcccacatatctgttaatccaaatattaccaatatcataacagctatcttaattgctaaagaaaaaataatattttgccataatattttattagttttccttgatactcgtatagcttctgaaattgcttctactttatccttcattaatactacatctgctgcttcaatagcagcatctgaaccaacacctcccatagcaattccaatatctgctcttgctaaaactggtgcatcattaattccatctccaacaaataaaacttttccatttgctgattttttatttagtatttcttctaccttattaaccttatcacttggcaataattcagcatgaacttcatcaatgccaatagacttagcaaccttatctgcaactatcttactatcccctgtaagcattatagttttcttaattccaacactttttaattcagataatgcttcttttaaattttcttttacttcatcagaaataactatattccctttgtattctccatcaattgctatatgaactatagtaccaatagtgtctactttatcataagaaatattgttgctcttcattaatttagaatttcctaataaaacttttttgccttttattacagcttcaacaccatgaccagcaacttccttataactttcaatttcatttttattaacttctttaccatatgcatttgcaatagatacagcaattggatgatttgaatttgattcaccaatagctgttatttctaataattcatcttcatttatatttttagcattaatatttgttaccttaaatactcctttagttaaagttccagtcttatcaaatactactatttcactttccttaagagcttctaaataatttccacccttaactagtattccttttttagaagcagctcctatacctgagaaaaatcctaatggaattgaaactaccaatgcacatggacaagatacaactaataatgataatgctttataaatccattctgcaaatgttgcatctttaattaaaagaggtgggactaaagcaattactattgcaatacaaactacaattggagtatatacctttgaaaattttgttataaatttttctgtaggcgccttcttatttgatgcattttcaaccaattctaatattcttgcaactgttgattcaccatattccttattaacttttacctttaaaacaccattatcattaatagctccagatagaatttcatcatcaattttaacttccctcggtacagactcccctgttaatgctgaagtatctaaaaaacttgtaccttctataactgtaccatctaaaggcactctttcgcctggcttaattacaatgatttcttctaaatttacttcttctggagaaacctttatttctctaccatttcttaaaacattagcataatcagctctaatattcataagagaagaaatagattttcttgatttatttacagcatatccttggaatacttcacctatttgataaaatagcataactgctacagcctctggatattctccaataaagaatgctccaatagtggcaatactcataagaaaattttcatcaaatacttctccatgaataatattttttatagctgttattattacctctccaccaattactaaataacttcccacaaatagtataatagaaattatactattacttccattgtataatagcgcaattgcatatataattgctcctactattaacatccaattatcttttaagattcccatctttccatttgagacttctcttaatccatgactatgtccattattttcctctttactactttcatgatgatgattatcaccagagcaacaactacttgtgcatgttttagtattattttttacttctttattgtctgttttctcctcaacatttacatgtggctctaattttttaactattgattttatctcatttattatttcatcttttatgctttcttcctttatttcagcaattaatattgttgtagaaaagtttactgttgcttcttttacacctttgattttattaaccttatcttcaattttattagcacaatttgcacaatctaatccatttaaaattaactttatttccatatagctctcctcccattaaataaatttcatcttttatttgtttttataatctctattcagtaatatgatgtaatcctgcatcaaaaatttgttttatatgctcgtcatctaatgaataataaattacctttccagctcttctaaacttaacaagtcttgctgattttaatacccttaattgatgtgaaattgccgattgactaatattcaataaagctgataaatcacatacacacatctcagattcaaataacgaacatattattttaattcttgtactatctccaaacactttaaacaattctgctaaatcatataatgtttcttcctgtggcaatttctccttaacttcttcaactacatctttatgaataatactacatgaacaactttcaatcttattttccatcataatttcactccttagtttatattatttgtatttaaaattattttattggtcttaatactttttattaattaaacatatgaatagttgttcatatgtttatatttctattatatgcttatcttagtaatttggtcaactttttttataaatttatgaactagttattttaaattggaatatattactccttaaaaattcagtatatgtaaaaaaggtaggaaaatcatcctacctctttaaattaatactcactaagctatatcttctaattcaccagttttatttatattagaattatttttactttttttattttctataaattcaaaaacaacttttttaaactgaattattaatgttggaataaaagcaaatacataaattgctacatattggttaaatgctaaattttcaacttcaaataaattttgaaggaaaggtacaaatagtacagcatttaataatgctaaccctacgccaaatgcataccacacatatttgttagaaaatacccctaatttaaatattgatcctttacctctacagttaaatccatgaaataatcttgctaagcataatgttgcaaatgccatagttgaagctgttaatggagttttatttggattgcctatataaaaagaaatcattgtaaatattgcaattaataatccctcaaaaccaattcctaataagaaatctttatttaatatagattctttttttcctcttggtttatcctttaataaatctctatttgatttttccataccaattgctattgcaggtaaactatctgttaaaaggtttataaatagtaaatgaacagctgcaaaaggcattggtaaagccattattgaagagtataaaactgcaattatccctgaagtattacctgataataaaaatttaatagaattttttatattattatatattcctctaccatttgaaactgctttaactattgttgcaaaattatcatctgttaatattacagatgcagcatctttagatacttccgtacctgttatccccatggcaattcctatatcagcttgctttaaggctggagcatcattaacaccatcacctgtcatagcaacaattttccctttatcttgccatgcctttactattctaattttatgctctggagacactcttgcataaacagatatatgttcaacattttctcttaattcttcatctgacattttatctatttctaatccttcgattgctctatctccatccctcaatataccaatttccttagcaatagcagatgctgttattttatggtcaccagtaatcataattggcttaataccagctgttatacaatccgcaacggcttgtttactttcttctcttggtggatcaatcattgaaattaatcctacaaaagtataatcatattcatcttctaacgttaattctcttacttcatttaattctctataagcaaaagatagaactcttaatccactttcagataaatttctattaacctctaaaatttcatttttatcttctaatgttaattgtctaaccccatctgacgtcataataaatttaactctatctaaaattacatcaagagcaccctttgtaaacataatattttttccatctatcttgtgaagtgtactcataagctttctatcagaatcaaatggaatttcagctaatctactatattcaccccttaagtttaattcatcaattgcaatatcatgtcctaaattaactaatgcaacttctgttggatctcctatttctttaccctctcttgaagtggaatcattacataaaattgaattcttaattaaatattcttctaccttattatctaaagaaatttctgaaccgttaattaactttctatctacataaatttttcttacagtcatcttattttgagttaatgttccagttttatcagaacaaataattgaaacagaacctaatccttcaacagccctaatctttttaattattgcattttctttagccaacttttgagttcctaatgctaaaactatagttacaatagaacttaatgcttctggaatagctgcaactgcaagagctactgcaaacattaatgaatcaagtactggcatttttctatataatgataatccaaatacaattgcacaaatagctaatattattattgcaagctttttgctaaaatcatctaaggtaacttgaagtggagttttcttttcctgggtttcctccataagagttgctattttacctatttcagttttcattcctgtatttgtaacaagtactaaagccctaccataagttactaaagatcctgaaaacaccatattcttttggtcacctaatgctacttcttctttatcaattttatctgtaatcttatctacacttaatgattcaccagtaagcgaactttcatttacttgaagtgaataactttcaattactcttccatcagctgtaattaagtctccagcttctaaaactaaaatatcacctggcactacattttttgaatgaatctcaatcttacttccatttcttataacctttgccgatggtgctgataacgcttttaatgaatctaatgattgttcagctttaaaatgctgaactgttcctaatgctgcatttaatataattacagtaaagattacaatagtactttcaacattgttacttaacatggaaataatacctgcagcaattaaaataaatatcaataaatctttaaattgacttataaatacttgaaatatactcttctttttcttttgatttaactcattcaatccatatttatttgtattttcccctatctgcttttcatttaatccatctttcgaaacattgaatttttttaatatttcctctgattcaattgaaaaatattttgacattgtgcatcctcccttatttatatctctcttttataaataaaaaagagactcttaatataatcctcaacttaagttattctttacttaaggattatattaaaagtctcgtaaccaaattggtatataacaccaggcatatgccgcgattgttgatgttatattttatactactcccctttaacaggttattcaatttttatatgagttattatatacctcttatcacgttttgtcaataatttctatattatatatatatcttatgattagttcttcatatattttacatctatttatttgtaaaaaatcataaaaattttcttttcacaaaattgtaactatattatatttcacatattgtatttttatggtacaattaattcacaaacctaccaggcaaaaataggtttaaaacaggggtagtctgctaatacctctgttttttctttttattttaaaatattctaattttttattttcatttttgtaaacgtttaaaggaattttaaacttttcatagaatatatatgtataaatacatttatttatagtatctagggtgtattaaaattttttaagcgagggatttaatatggaaggtatttataaacacaataaagattgttttgatgtttacatcaatgatagaactacaacagatacagatgaatttttaggaaaggttttaaaatacctaaaaaataatggtttttcagttttcttgaaaggtttcgataaatataatcgtccattagtagaaattaatggcactctccacactgcagatagaaatactgcttgctgcattgttgaaagatttataaacgtaaaaaatgaaattaatttaaatgaagattcagaaagatataataaaatagctagctttattgaataatgtcttctaataaaataccccctctaatgcatttactacataagaggggtgtacttattttcaattacataagatattgaattaataatgttgctaaacctaagaagaagaaaaatcctaaaacatcagtaaatgttgtaacaaatattgatgatgctaatgctggatctactttaaacttctttaaaacaactggtactaaatatccagtaatagttgctactatcatatttaaaagcattgctaccgatataattattccaaacatgaagtttccttcccacatatatcctaatactccaattatgaatccaataactactccagttactacacctactccaacttctttaaagaatacctttttcatattcttaaagttaagctctcctaaagctaatcctctaactataatagtaagtgtttgtgttcctgcatttccacccattcctgtaactattggcataaatgtagctaaagatacaactgcttgaattgttccttcaaacattccaactactgctgcagctaatattgcagtaaataaatttacaattagccaaggcaatctgctctttactgaatcttttaatgatccatcaactttttcgccttcatcaacaccacctagacgatgaatatcttctgtagtttcatctcttaaaatttgcataacatcatcgaatgttactaccccaagcaatctgtttgaattatcaactacaggcatagttaaataaccatacttttcaaatctatgccctacttcttcctgatccgtattataaaggatcccttctatctttgtatgaataacatcagatattctggtattaaagttatttgtaactaattcccttaatgatattacacctttaagcttatcaaaattatctactacatataaatcataaatattttcgttttcttcaccatatttttgtaaatattttaatgtttcttccactgtcatattttctttaagtgctacaaattctgttgccataatacctgctgcagtatctggatcataacttaataattgacgtacctttcttgcatcctcatctgtcatcttttctaaaattttattagccttttcttcatctaacatacctagtaaatctgttaattcatcagatgacatttcctctacaatatttttttgtttattttctgaaaactccattaaaatagaatatttttcttcattatcagcttcatcaattatatctgcaattaatccttctggtaatctatataaaatatcttctttatcctttggataatcacgtaaaatatctaaaatatctactgggtgtatactttccacatatttaataatgcttgattgtggagcatgtaataaaaatcttcttagttcatctttattcatatttaatttcatagcatttcctcctagtttttatacataggaaaaaagccatctttacttataattttaatgatatatatccaatttagtttattagctacatatcattaaaaccatataaaattgtggtataaatgactacattccaatgtattatatatttagttttttcaataattaaattttcactcagataagggtccatttaataccacctcctaaaaaaaacaaataaaaaagactttttgtccctacaacaaaaagcctgttactcacttacttctctatttgtagagctttagcactataaagcgtagacatatttttcagtcagctacattaaaaatcaccttagcgatgatttctgttgacccattggaatctctagatttttctgggcagcagcatttttctttataggagcctcacctaacaatccttattaactttcattatacttatatagtattccccaaattttaatttgtcaattttaaaaccatttattaaaaatttaataaaatactaattgttttatataaattcaattattccttttcctaatttaccaatcctagctaaagagtatacatcatatcctttttcatctaaaattgctcttccaggttggaatgatttttctattacaataccaattcctccaactttagcaccagcttcttctactaatcttgccgctcctaaagctgcttccccatttgctaggaaatcatctattattaatacattatcatcttttgaaatataattctttgataaagttaattcataatctgttccttttgtaaatgaatgtacagttgtttgatatacttcaccatttaatattttagaactttgcttctttaatgtaaccattggaagttccatttgcatagctgtcattacagtcggtgcaatccctgaactttcaatagtaaatatctttgtaattccatgattcttataatattctttaaagcatgtccctatttcatacattaatcttgcatcaacaccatgatttaaaaacgaatcgacctttaatactgtttcacttaatgctcttccgtcttgtaatatacgttcttttaaaatttccatttcattccctctcttaaacttaataaaaaaataacacttctaaatatttagaagtgttgtgcattctctatacatataattcaaatataataacaacaccccgtagtctactgttttacggtcagtaggtagaaactttcggaccaaattaccgattttatacgagtatcttaataaattcacttattcgtattataccacgaacattaattttgtaaatatgtttttaatttgtatttacccatgtttttaaaagaaacagtccattatatatatctatgtaggaataatttcactaatagaagtaagtttttagtttttaataaagtttaatttataaattaaaagtatatgatcttatttaaaagaccttatcaaattatttatgcatttactaattgcattttaatttgataaggcctatttattttaatatctacaaataattgttgtataatcttctatattttcataaatagccttagctacgctatatggcatatttacacatccatgagaaccattagtctgatatattgatcctccgaaactacttctccaacttgcatcatgaagtcctatccctccattaaatggcatccaaaaacttactggtgaggcatatccatctcctcttagtacataatctttagctttccaatctaatttatatacaccagcaggtgttgaatgaccttgactaacattaccagttactacatttccttgagtaataacttcaccatttttataatatattaccgtttgatttgttaaatctacttcaacaaatgtattaagaacatattcatcagttgctgttggtgttttaaatgttaactcctttgtatctgtacctccaccttctatagcagaagtaatgtcagctatagctgtatctctatctaaataataaattcctggtgtcgtacttatttttattgtttctcctgaccatctagtaaatgttcttgtattacctatattgtcatacttgtcccctaattgatttacatattctctaatactatcttcatttaaagatacattaaaatcatcatcaattgtaatccattgattaatcatacttccatcaataacttctgagctttcattaatattaagggttactttagcatttacatacttatcagcagtttttttcgctttagtaacagctttcgatttagaagtatacgttggattttcataacaaccttcatcatctaaatttaatatagaatttatactgtgaatattattcaatatctttgaatttaactcatcaactttaactttatcaccaatatcttcttttactatttcatactctccatttacgtaattaagagtagcattaacaggattcgttacattattttcattaagagcttctaaatttccaatagcttgatttaacaaactttcatcataagaaactccttcagacacattataatccttatgttggaatattgatgctatccataaaaaaggattttgttcatctaaaatattattaatagcttcagtaaaatcatatttcaaattaatagcttctccacttattgtttctgttttatcatttctttcttctaaagtaagtacatattcatttgccttatttgccattaattcttgagctgatttattactttttcctgaaatacttacgctattaattgatgttctaaagaagaaatgactgttaaaatataatgccattaataagtaaactcctaagatacaggctaaaacacttgcagcaataattaatcccttatcgctattctttttaactttactttttggtgtttttatttctttatctaattcaaccgttgccatttgggtattactttctatctctttattttgtatatctttattaaaatcattattttcttttaatattttctctagttcatttatatatttttcatagtcattaatattcatcttaattgcaaatgctgcaatactttcttttgccttaattatttcttcatttttatctttactcaatgttccataatattcatctaatagcttactcttatattcatggatgttattataccctaaaaattttcctaaatcttctatttgattttcctcatcaccatatttgtatagcaatgccttatatatattttcattatatgggttaagttttattatttcttctatagttttagtttcttcatctttaggaatctcatcttttagtaaagctttgattaactcattggatttttttatatcttctgttttactatacttatctacagaatcaacgttattatcatttaaaaaatcaataattgcaaaattaatattaaatatactttccatcattgagtttacaagcttgtctaatatttcttttgaaatgttagacttattatttttatcattaatttctatgtccttttcttttatttcaaaggggctttttattagatctgaattaatatttaatctagataatatcacactcttattactgtcttcattatattcatttttaattttatctaaagtatcttcccacgtacagtatttatcgaaataatactccttaaaaaaggtatcattatctatatcacttatttcaaactcttttataatatctactgctatttttatataattatttaaataattatatccaaaattttctccatctttttttaattgttcaacatcattaaatctatttatacattcacttttaaatgtatcaactgatttaaatgcttcttgaagaaaccttccccttatctcatttaatttaacaaatttacttgaaaaattgatatccccatttaacaccttaaagttcatactacctcccatacttttagcatcaaattcattaatgcattatccccatttttttcatctttcataataatattatctatttgttaatttattacaattttaacacatttattgactaattggtatcaatattttctatctaaacttatttaattctaaaaaaacaaatgactaaaagcataccctacataaataaatgcaaaattccatatcgtaattcctattgctgaatataatgaaaactttaaaaaattaactttaaatgtccctacaactatagatatcaatgttctagccacgggaattaatctagataaaaaaatacctaaatctccatacctttctatacatttaaatgttttatcaataggcttttttgttttaggaaatttattttcaatcctatctataattggattaccacaataatatcctattgcatataaacaccaacttccaagtagcgctgctatcaccgatgtaataagtgtaatttgaaaatttaatccacttgattttataagtattccagccgccggcattataatccctgctggtagtcctggtaaatttaaatattctaaaaatactattcctgccaaaaacaagtaaccatatctatccatatatgataatatatcattaatatcaatcattttttcctatcccttctatataattatacagaacaagaaactttagtaaagtttactaaaaatatttcaatttatattccaccaaaaatccctttgaattttatttttcccattaaattcatactatattcatttatagaataattactttaaaataaaataattctccatagaataaaaactttactttttattctacagagaatctataatttaaatctctttatgcaagtacaatattatttatattaacacaaatatcatttgtaattttactcattccataactgagaagtataaattcccttatgaccagaaataaaaaatgatattatacataccaacattgcaaatataatattatttgtcctaaaaagctctaaatacatcataaaacaagctataggtgcattagttgctcctgaaaatactccaacaagccctaaagctgcacaaaatgcaaatggtaaaccaactatatgcgacaaggttgctccaagagtagctcctataacaaataatggggtaacttccccaccttgatatcctgcacccaaacataatgttgtcaatataagcttaataataaatgctagactaggtgcttttccataaaaggcatcattcaataaccctaagcttaaattgttatataaattatttcttaaaagcaacgtagctattaccattaaagtaccaccaacaaatattttaaaatattgatttttacaatactttattaatttttccttaaaccaatgtgtcatataaacaaataatctgctaattaatccaaaacaaattgctaatgcaataacctttaaaacattaattatattaactgcttctgatgccgctattttatagtgactatgtttaacacctaaatattttacaacagaatttcctaccaatgctgaaactatagctggtagcattgaattataacttatacgccctatattagcaatttctaaggcaaatatagttcctgtaagtggagttccaaaaacagatgaaaaaccagctgctacaccacttattaataatatcttcttttcttcttctgaactttttaacgctttggctaatgaatttcctatagttccacctatttgaactcctgttccttctcttcctactgatccaccaaaaaggtgagttaatatagtacctaagaaaactaatggcgccataatgaattgaattttttctttacttccatttatattttcaattattatattatttcccttttgtgaattaccaccatacttgctataaaggtaagtcataaacattcctgaaaagggaagtacaaatattaatgatttataggctaaatttaaatctatagctttttctaatagcatcaaaaataccccaatacatagccctgaaaccccaccaattactactgaaactaatgctaattttaatatgcttaacttgctcatactattcactccatttatatcttatacttattaaaattccctaagtatagaaatatatttatttgcttatagtgctattcatattataataatgctaaacattaaagctttcacatattgcgcctcatgtccaactctgatataatcaaaaattgtagggaatgaagttctcccttgataattatcaaaaccgcttattatagctaatgacttctacaactttttttgttgtagaaatcattagctttttttaatttttaactttattttttctattttataattataaagttttaatattaaaatttaatttcatttttggaggattatttatgttaattaatgttttagtaattataattagcttaatacttattggcgtattagctaattacagtggaaaactggtagaatttataaaactaccgtcacttataggcatgattctatttggaatgtttataggtccatccttttttaatttggttccaaaatcaacattaaatatctcgccatatattaaggaccttgccttaataactgtattatttataggtggccttggaataaacttaaatcaaatgaagcaaattggtcgacctgctattttattaagtataatacctgcaaccttagaaggacttacaattgcagttttatctatgatatttttaaaatttacctttgtacaaggcgcaattttaggttttataattgctgctgtaagtccagctgttttagttccatcaatggttgatttaattaaaagaaaaatagggcaagataaagcaattcctcaaatgcttctagttggtgcttctgcagatgatactattgcaataactttatttacaacctttttaggaatatatatgtcttctgttaacggtaaatctatttctgttataggtgaacttataacaattcctcttaccattgttgtaagtattttaactggtttgctacttgctattttaacgaagaaattactaaaatcaattagtcataataatttaagagttattttagccattatagtttgcttaataattagattagtagaaaacaccttccacttaaaaatatttaattctttattaactataatgctttatggtttctttttaagggcatttttagatgaattagctcttaaaattcaagatggaataaatattgtatggaagtatggaaaaatatatttatttacctttgttggtatggcaattaacccctctctagttggtaaatatttattgattggaatagtaatgcttactatctctttaactgttagatctataggtgttgctatttcattaattggtactaatttatcttttaaagaaagagtattttgtattatagcttatttacctaaagcaactgttcaatctgcaaaagccggaatacctcttcaaatgggtattgtcggtggtgaagttatgcaagctattgctatcttaagtgtattaattactgctcctattggtgctattggaattaatcttacttctcctaaacttttaaaacaaaatgatgaatatgaagagttagtcgtataatattaattttcttataaaataaaagtgacaaattgaatttactattaaaactcaatttgtcacttttaacctttcattaaataaacgctccaaattcaggactatcattaatatcattcagtaaatgcttaatttcctgatctttatccttatccataacaagaataacatctcccgcatcaacaactactaaatctttaactccaaagccgataatcagcttttcattccccccaaatatggagcaattttcacaatcttgaatatatacattactacttattttattattatttctatattgatttaaatatctacttaatgcattaaaactacctatatcatcccatttaaaatctcccttgattacataggcctttctagttctttgcattactccaaaatcaatagaaattccatcaattaacccatattcttctcttgttacttgatcctcatcatcttctcctaaatgttgatatatattcattaatgatttatacatcttaggcaagtacttttcaatttccctcagtataacatctgctctaaaaacaaacattcctgagttccataaataagttccttttaataagaaatcttttgcaacctcaatattaggtttttcagtaaacctagctattttataagcttgagttgctgatggtatcctttcacccatttcaatatatccatatccagtttcaggccttgttggattaattcctatagttacaatccctctacgtctatttgctatttcaatagcctctgatagtgtatctaaataatccttttggccctcaatatggtggtcagaaggtaatactaccattacagcatcattatctttttttaataacttaatagctgataatcctatacaagtagcagttgctatatataactatttaggttcttatattttctttataaattccatttaatattaataattccgttagtatcaatataaactttatctattaccattttaagcattgcattattccattgttctactggtacacctataatattttctacatcttttttaaagctactttgtttaactggtaagttatttattttatcttctataatttctttattcttaatgtgtgtatctaataatttactaatactttcattttgtaacttaaattgtgtaattgttaatgctccagcattatatagttccattaaattattggttttcttcatctgttcatctatacccttattaatcgccttcaattctccctctaggcttgatttaatatcattgttagtatttatattaataatatcaaaattacgctctatgattgaatttaactcacctttgatatgctctattagaaaatcttcatctatcctattactactatgaccaacggcaacacccactttttcatatgctgaacaattataatgtaatttctttcccttctttcttctgatagtcatacttgaaccacagttattacaagttaataaattactgaataaacttgcattagatgctctttcaattcctttaatactatatctatgtttttttgctttttctgaattaattgtaaataatttatttgcttctatgaaggtttcataatcaataattgcatcatggttattataatgtttaatccagttctctggctcaatctggttcatttttgatatagttacatcaatagtttctgatttaccttgtataagtgtaccggtataaacttcatttaatataatattttttattgtgttacctctaatgataccaccatttttaccctttataccttcagatgttaaaatattacctattttattagttccgttaccttgtaaatatagtttaaaaattctttttattattggtgcttcgagttcatttataacaaaattctttttgttaatatcataatcataaccaaatggagcaatacagttgtatatttttccagtttctttgaaatggttaaaaactgtctttattctcttacttgtgttttggctctcttgttctgctatccatgagaataaaccaaactttgttatatcttctttactatctaaattatcttctatgaatattattcttatattattctctcttaattctttaattgctcctaaagtttccaccatatttcttccgaaacgtgaataagattttgcaagtaatatatcatatcttttatttttaccatcttcaattaattctttccattcagttctatatttccctttcgtaccacttattccatcatcaatataagatttatataaaatacaattattcttttcaatccaactcttaaaaatatcttcctggtttccgatacttgttttttgactttcataatctgttgaagttctcgaaaatgttgctacttttaacattaatttcattcctccttttgtaaaaaaataatctagcataaatatattttacgctagatttacaactttttgaagtatttcatttatgttattattggaaaattcatctataaaggtataaacttttctacctctcttttttaaagtaatttttaatttttcatcttcatatattactttatcatctccaggttttaaagatttttttaaatcatctagtttgtccacctttataaaatcataaatatttatcatttccttcactccatgtattaaagccaccaattaaaaaattggctctttggttggagtaaccaaaagattttacacccccctttatactatgaattataattataaaatatctcttaatatttatattttataattaagatttgaataagttcattcatgaaaatatgtaatttataccttttgtatttatattaaataattaatattaaatatttttgatagtcaagactttgactttccaaaactgctataataaaatatcaattttattttatctaataactatataaagcaaaaaatggagcatacacaaaatatttttaattctgcatatgctccataattataataatctattaatattactttctttatcttctaaagttccccatgctcctataaaaatttctttatgctggggtaaattacaaatcattgttaacattaatttataaaactttaaaactgactttaaatattatgtatgtcattacaattgaataaacaacaattattaagcaacctattaattgtattgagaattgctttaatccagcagatattccatttactcttgggtttgcaagtactcctactaatattgtacctataaatccacccattccgtgaactccccaaacatcaagtgcatcatcccacttctttctttcgaattctacacagaagaagcatactacagctgctattgcacctattataagtgctcctaatggatcaatatatcctgatgctggtgtaactgttgcaagtcccgcaattgcacctattatcatctctaagaaagatgctcttttactatgcatagcatacaatattaaccaaactatcattcctgtagctgctgcaactgcagtatttgtaacaactattgccgctgtatctgctgctgctaaagttccacctgcattaaatccaaaccatccaaataatagtaaagcaccaccaattgcaactagtcctaaattaaatggccctttttcatttttatactttcttttacctagtacacataatgcacctaaacatccaaaacctgatgtaatgtgaattactgctcctccagcaaaatctacgaatcccatcttagctaagaatccgcctccccaaacccaatgagctactgggaagtatataattatcatccatggaattaatacttttatccatccacttatagttaacctatttgcaaatgctcctgtcattaatggtgccgttattatagcaaacattaattgatacataaagaacattataaatggtgttgtactgttgtatgtttcattaatagcaaacgtaatgtctttgaatgcaaagtattgaagtggattaccaataactcctccaatgtcactaccaaatactaagctaaacccaccaaatatccataacaatgatactatacctattgctataaaaatttgaaacatgatcgttaaagcattttttctttcgactaaacctccataaaaaaatgctaaccccggtatcataattaaaactagtactgtagctaaaatcatgaatgccacatctccattattaatcataatacccctcctttcgacaaatttttcttatgctgaaatagcacagacaggagtatatcaaaatccatttaattttgtcaacgtcagtccaataagttgaattattttaaattttctcaattttctaatattctatattgaatttatatttataaacaagtaaaaaaactatggaaatagcttaatttgggctatttccatagtttttttaactcaaaaaattacatactaaatttaaaaatttcacttcattatctctgctattttatataaataatttaattactagtattaactaatttattattaaaatattctaaagttaaatataattcttgatttacactataaaaaattccatttttttcatctttataaatgtaatttcttcctattaaaattgatattagtaatctcactcaaataatattaaaaatatcaattctctttttttcaaaacactgtccaagtttttcctaataaattaacaattattaatatcaataatcaaatcattccacttccgattacataattttctccattaaaatctctttctaaattttcaacttcaattttaatattcttttattttaaattaaaattttcttacaaactccttaagatacttttttataaatcaaattagacccaataaaactgagcaaaacacttagttttattgggtctatcaatttaatatattttttataattaaagttaatataaaaacactatacatttaatttttttatataaccatatttttaatagcttctatataatacatttcagaattatcaatagttttttctatttttaagtatttatttattattttagaattatcctctacagataataatatatcttctttcactatatcacttttagaatgtacatgatttatttcgtctctgctttgagaatgagctattatgacctttccattttcgtttaataattcagataaatgttcaaataatttttccttatctttaaaatgaggatatgctgaatatataaatatataatcatatttatcttcattaaaattcataatatcagatactataaatttaacatcttcatccttatattttttccttgctacttctatcatattttctgaaatatcaacaccaactaattttgatggcaatttttctagcaaataactaattaatatacctgtacctgtacctatatcaagaatttttgaatctttttttacatttgataattcaagtatttctcttatttttttatcatcatgatcacatatttcatcccacttataagccaaactattaaaaaattctctattatccatttatcgctacttcttcctgctttacatgatctacagcccttaatactacaggtattaatataagctgaataattattcctggtattgctttaataaaagttgtagttaaaaatgctgtaaatacaaaaccatttcctcctactgttaacaatatataatttgctattcctgataccattcgcccaacaaccatagctacaattaacgatagaaatatattgcactttttatccttatataataatcctgtaagtactccatatgttgcaagttcaaatgccatagcaacccctgttggaaatattgatggcattcctaaaagtactgaattaacaaaaggtaataatattcctaaaatcaaaccatatctttttcctaatattacttcgcataataaaactagaatatgcataggtaaaaatatttgtcctgataagctagttacatgaaaaatatatggtataactatacccattgcaagaaataatgcagcccataccaaatcccttgtttttttattcataaaaactccgcctaataatttatttccatttttcagaaatcatttattaacaaaattgtatcattttaaatttttctcaacaacctaggcatggagatatatttctattttcatctttaatttctattatcctttttaattagttatttctaatatttcaaatatctcacgtatacatagcggtattcaaatgcataaaagaaagagctatgaaaatgactgctatttcaatataaatatttaattattccttgatgctggtaaataaggtattattctttcagcaaaacttggcattgtcatagtttgtagatatactctacctggaccagttaaagtcgttaaaaatagtccttctcctccaaataatatgtttttaaacccttttaccattttcgcatcatatttaacacttctttcataagccgctatatttcctgtatctactattaatttttctccaggtgctaaatcttttgctactacactaccatcaatttcaagaaatactttacctctacctcttacttcttgcattataaaaccttctcctccaaagaatccaccttttacacttctattagttgtaagtgaaaggttaacgccttgttctgcacataaaaatgcacttttttgacatacatattctcttccatcagataaatctaacactattatttcaccaggaaaagatgaagaaattgttatttctccgggataatgtttagctgtatatgttgccataaatattgaatcaccagacatcatacgccctaaccctttaaataatccacctttcatattcgtatccatttctatattttctgtcatccaagtcattccaccagattgtgtataaatactttccccttgatttaatcttattgttacagccggtaaatttcctccaaaaatattatattccattttattttcctccattatgttttatttattattctatactatttaaatctaaaagctgacttatatgacttgatgtaacctttggtaatacaccattccgcttttcaatatccatcttacttaaaattttctcattaagatcttatgtcaaaatcttatttacttctcttaaataccatctcttaaattatatacaactctaatatatcctagttttattttatgtgttgatagtattattaattctcttccacaaaaaagcatatgtatttttatctttgtatgtactttttataatctctttacacatttgttgtaaatttataatatagtatttattaacttatatcaacttatctttttctctatttatagaattattttttaatattttacgatttattgcctttatataaagtaatggcctatttttctttaattttcttgatatactaaagctattctatagaattcactaaatcactataaatacttttataaaaaaagaagccttaaagcttctttaaatagaaattatatattacttatattcataatcacaagttatatttgttaagaaaaggtatgagaaataagttttctcataccttttactattattttaatattagtctttttatattcttttataaattaaacttccggttaaacctctaagaattcactttctttacatactactggtaaattaatagtcttataataacttaccattcttataactactattgccattatagcaataaattgtgctacctttattccaataaacggataaataacccaaaataaagtaacacctataattcctgcaacgcaataaatatcatgcttaaatatttgtggctttctatttgttataatatctcttaaaacaccaccaccgactccagttatactagctgcgaatataaataacatataattataattgctaccaatagctttaactgctgcagatacaaaaaatgctgctagtccaatagcatctatgaaaacaaataaattcttgtactttagccttcccttaaaaaatattgcaaataaagttccagcaataataaatggaagagtcatatagcttgtaaaaaatactggtataccaacattagtaacaatatctctaagtacgcctccacccattgcggtaattactgcaattatatatattccaaaaacatcaaattcctcttcaatagctactattgctcctgatacggcaaaagcaaaaactccaatatactcaaaaatcgttatgtagtccaaaaaaaatccccctcatttattttccaatagactaattattaaaataattgcgcctctgtctttttacctgaaagattctcctactacatttaagattgcttcgtcggtgtcctttttttaattagactttccagagttttctcaaaatttggtccttttgcctgagagtttgccgcactttccccttcggctctgtaaatacacagtatctcccaaatttctcaacgaaatacctgtaaattataatatatccataattatagttcaatatctaaaatgcttttaattctattttcatttaaaatatgtttacctatattaaataactccttatcttctgtaattaaagttaaactctcatcaatataacaagcatttatttgtaataaatcattttttgataaattattattttcaaattttccttttatttcgtaatcatatatcataaagaagccactaatatcattatttttaacttcaatactacagggtaaaagcttacaaaacctttcacttaaaacttcttgccttctatatatttttttctctttaatggacagttcttctaaaacttcttttaatataacaactttattttcctctattaatttctctaaaagcattgagttatcatcccaaagtttaataataatattagtatctaataaatattttttcatttttaattctccttttatctttattgtgtcgctattatacaaattctttttcattgactgaagacattatccattaaaactaacaagtcattatctaaagctaatcttaatatagcatataataaaatattttaatttaatttataaattcacttttatttcacaatatttatcctaatagaataagttgttaatgtaaattttttaagtccatacgaataaaataggtactggctttgaaaattcacttattgaagtaatatcaaatgcttctgatatttctgcttttgaaaagtatggggatttagaagcaacctatctaagatcattattatagcttaaatattctaacgctaaatggaatgctgacaaacatgattttttaaaatgaaatttcttactatacaactttatgaagtatttaaattaaatatctcataaattaaaatacctttggttattacatcagtaacaaccaaaggtatttcatagccaaacgactatgattttccttagtattccatagtcgattcaattttcacacttttcgacaactatcaaagtcgcccaaaacctctattcatcccatccttctgggaattcagcattgtggtaaacttcttgaacgtcatcatcatcttcaagtaaatctaacatcttttggaacttcttagctgcatcttcatcaatttcagtatatgtatctggaatcattttaactgctgcttctaagaactctaatccttcagcttctaatgcttctcttactgtaccaaactcttctggtgcagttgtgattatgaatacttcttcttcatctgagttgaagtcttcagctccagcatctaaagccatcatcattaattcttcttcgtcaaggtctcccttttctataacaatttcacctttttcttggaacatgaatcctacacatcctgtagttcccatatttcctccacctttagtgaaagcacttcttacattccctgctgatctatttttattatcagttaatgtgtcaactataacagcaacacctgatggtccatatccttcataaacgattctttcgtaatcaactgctcctaattcacctgaagctttctttattgatctttgtactgtatcatttggcatgtttgaggcctttgcttttgctattgcatctcttaatttagggttgttatcaggatctggtcctccatttttaacagctatcattaattctctacctattttagtaaagatcttccctcttttagcatctgctttaccttttttattttgtatattatgccattttgaatgtcctgacattatttcatcctcctaaatcttataaataatctaaaaatccttattattatatcataatgaaaaatattaaacaatttttgtgtaaatatatgaattataaaattttaaacaatctattttcttccttaaaataaatatcttcttcacttttttcaacaataatctttccattacttgcttctatagcttctttttcaatttcatctgcaactgaaacttctgctaaaatatgaactataactttatcagtatattctgtatcttcaatgtgccaattattttgtccacaaaaatattgcactttacctatcatatcataatctaaatgtaaagaaaccttcacaccttgaactttctcaactacaccaccagcttttaatgctatagatgctccctttgtatatgccctagtaagtccccctgcaccaagtaatatcccaccaaaatatcttgttacaactactgcacaatctgttatatcagattttttcattacctctaatattggaatacctgctgttccttgtggttctccatcatcactatatctttgtatccccatattttcacctataacatacgcccagcaattatgtcttgcttgtttatgctttgactttatctcggctacgaaagcttttgcttcttcttcattttctaccctcttagcatatccaataaactctgattttttttcaataaaactatcttcaccatattctctaatcgttatatatgccactgatctaactcctccttaataatgtcaattccccttgatatttcatcttcattaacttgcgagaatcctattttaaaataactttctcctaaatttaatcctctataaaatatcgttcctggagtaatataaacacctttttcctttaacttataaaataattcttttgattgtatatttttattttttatatttaaataaaaacttaatccacctcttggatccataaatattacatgacccttaagtttttcatttattaactttttcattaactcatatctttttatataaccattttttaagtcatctatatagccaatccaatagccttctttaatatacctctctaatgctctttgcattagtgtagatgtagctatatccgtatttattttcgaattttgaatactttctctaaatttctctggacatattatatacccaagtcttatacctggcaaaaatattttcgaaaaactttttatataaataaccctatcattagtatctaaaactctaaaaggttcatgttttatattttcatcaaatattaattctgataaataatcatcctctattatataaaaatcgtatttattagctagttctaagattttaagcttcttttctttactatagctaatcccagttggattttgaaaataactcatagtataaaaacattttattttatttttcttaagaacttcttcaaactttttaatattaataccatcttcttcaattggtatttcaaatacattagcccttctaaacttaaatactgataaagcaccagcataagttggtttttcaacgataacattatcattaatatttaatatggccttggaagcaatatctattccttgctgagctcctgatacaattaataaatcttcaacatttaaagaattattccaaaatacttcattaattgtacttcttaattgtgaatatccaaaagcttcttctttaatcaaagcttctgctccatctctatctaagacttcattaataacctttttaaatttatttattgggaaattaactattcttgagctttcaccagtaaaatcaataatattgctatcatatttattttttattaactttatttctttagaatattctttcttaaagtaatctactatttctctctttttagcaaatgttcctgaacccatcttctgatatgcataaccttcagaaacaagcttattataacaatttactactgttacattattaacttttaaagacttagacaattcccttataggaggaagcttatctccatctttaataattctagaattaattaactttttaatattttctgctatttgaacatatttaggctcataatcattaaaatcaatactatacttttccatcttctctctcccaataaattaatacctcaaatcgtactcatacaatttattataaaaaatttaatatcctaggtcaaataaaaaggctgtatcagaaaataaatttatctgatacaaccaactatttaactaactatttatcaccaatagcttcaaatgtattttgaataaatacacctaatgatagcaaaatacaaataaacactgtaaacccaccaacataagggatgaatgtaattaccttaacaattagcgtaaatataattgctgaaagatatgcattcatattttttaatacaaacctaccaaagataatacctgtgaatactggtgctaaatatattagtattccataaataattaagcttattaccgaaataggaattccaacaactgtaatacataataaaattgcagctataggcaaaactattaaagttgcaaatccaattaagaatggtagccaagccctatgttctaatttttcacatgctctattgttatatctactacaaaataaagttattaacacacaaaaaacaattgcagttataagacttataatttttcctacaatattaattccagcaaataaactctcattgtcataatcagtattgattttgctaaaattgattttgctattatcaaagtttcctaatataataggatcctcttctgctcttacttcaaatgttccatctacttttgcattttcaccaattattaatttactacaattaacttttacattaccagtaattgttccatttattgtaactgtatcagcattaacaaataaatcttctgcttctccgttaaaattcacgtctccacttgccagatatatcccttttgcttttgttccatctttgatttcaatactagctgctgctgcatttatatttctttctacatttgaattaattgatattgttgccccggcaaccctaatacttccccctacattttctgtctcaatagtaatgttatttcctgctacaagaatgtctgcttgaaccctccctgcaaattttaaattatttcctattgcatatacgtcagattgagcatctaatgtttcattaatattattatccgtgaaaaacttatttgacgcactatctaaagtatcagcataagcactaaatgaaaaactgcttattaataaaaaaccaatagcaaatagtacaaagcgctttaaatttaccctcattaataatttccctcctaaaatttcctatacactatagtatatcacattataatgtaaaattcttcataatccaaactgctacacttccattttttactttaaaattgccataaccttcattatcgattaaaatttcttcctcgcttccccctaacgcatcaataaattttttaccagcatattttttactaatatacattttcttttctccacctaacctattagtaagcaaaactgccaacccagaattttcatattcatctatgccctctctagtccatccaattatgtttttatcattaaaataatcatattgttctccataacttaatcttttcctaattttcaataaaatatccagacattttccaactccataatatgctgaacttggaatcccataataatctccataaaatacacaaggatatccttcaattcttaataatattaatgcatatgcaattggcttaaaccatggttctacccaagattgtagagcactaccgatttgtgtatcatgattatctacaaaagttaccgcctttgtcgaatttctctcaacaagagttcctttaaagatatttctcatatcaaaatccccattactccttgatgcctcataaaaattaaaatgtaaaggaacatcaaatagagacattacatttttagtattttttatataatttaataaaacatctacattagggtgccaatattcacctacagcaaataattcttttccactttcctttcttaaatacgtaagccactcaacaaaaaaatcataactaatatgcttaactgcatctaaccgaaatccgtcaatatcagtaaactctaaataccattttccccatgattttaattcttcaacaacttctctatttgaaaaatctaaatctgcacccatcaaataatcataatttccattttcattatcaacatacttattccattctttacttaaaaatttatatatactatttctttttgttttatcatcataatcaataccatcaaaatcattccaatcccatttaaaatccgaatacttattatttcttcccgtaaagttgaactttgtccaagctttgataaccttcgttccactaataggtatattcctattaaaaaattcttcttcgcttgcttcaacttcttcaacatcatctccacccattttatgatttacaacaatatcagcataacactgaatattattttcttgtaattttttaattgcttgtagatattcatccttactaccatactttgtttcaactgttcccttttgattaaattcacctaaatcatataaatcatacgctccatatccaacatcatatattccaccaattcctttatatgccggtggaagccataatgcagttattcctaactctttcaaattttctgcttcatttaatacttcattccacaatttacattttggtagtaagaaccactcaaaatattgcatcatagttccattaaacatgtaaatacccccataattcaccttagtttatataaaagatggccctaatattgctaaatatcaattattcatttaagtacctatgaatagtttttatggtattattagaataattcatatttttaaaataacaatattagggcctatgttaaaaagagactacttaaaactaatttatctcattgttacaaacatggataatctcacctcatctttagtatataatgaactcatcttcatggacacttatactaaaactaagaattttttaatcttaagtaatctcttattaactattacattattatatttatgatgtaatcctttgatttattataactttcgtcatcaacttcaacaatcataaaagtaccattttctctatactcttcttctaagactcttccatttctatgaaggaaagaactcatatcacttctatcatatggaattaaatactcacacttcttcattttataaggaagattttcttcaataagcattaataattcttctaaattaataccttctcttgctgaaatttctattgtatcatattctgctgttgcttctttaattgcttctatttgttcttctgtagccttatcaattttatttaaaactaataatgtcttcttatccttagctcctaattcagataaaacttcttcaacagctttaatttgctctaaagccgtatcacttgatgtatcaacaacatgacataaaaggtcagaatagataacttcttctaatgttgatttaaatgcctctactaagtcatgaggaagctttctaacaaaaccaactgtatctgttagcgtaattatccctttattcttaagaactattgctctagtagttatatctaatgtagcaaacagcatatctgcttcaaataccttttcttttcctgcaacttctttttgtgatgctacatcacaaagggcatttcttaatgttgatttacctgcattagtatatccaactaaagataccttaggaatgctttccttatttcttttttctctttgagtttctcttatttttttgattttctttaattcatcatttaaatcatatatttgttcttttatatgtcttctatcagtttctagtttcttttctccaggtcccttagtacctatacccccaccagttcttgacattattgttcctaaaccttgaagtctactcattctatactttaactgagcaagttcaacttgaattttagcttctctagactttgctcttcttgcaaatatttcaagtataagtgttgttctatcaattactttagctccaatagctgcttctaaatttctaacttgtgaacctgataattcatcatcaaatataacaacattagctcttaacttttgccttaattgagcaatttcaagaacctttcctcttcctatataaaatgctgcatcaattttacttctactttgatatacactttcaagtactggtatatcacaagcttttgttagttccttaagttcttctaaactttctcttgtatctgaaccaactaagattgccttttcttcattatcttcaattatttccttttcttttactaaagagtcaatataatttattttgtttaaaatatgaatctttgtaattttatcaagaggtatattaccatcttcctcataatctagcttatcatctgttacagtaagcatacctaatgaacaatctaatatcttaccttcataaattccaattgctacaatagcatccagctttaatttaattaatgcgctaatatctaatgctgataaattactcattccatttggatgtgtatgaataattcttactcctgctagcctcttttcacgaatatctaaagtttcaatttcaacagatgttgaatcgccaattgctatagattttatgtttcctcttctatcaattgcaacacttacttctctttcaataaatgctgatactctagaaataacttcaattatttcccttgaacaaacttcatcctttggacatttaactttatataatctatctaattcttctatagcagatttttttactccatctatatttccatatatcatattttcacctcaatttaaaaattgtttatatatctggtaagtaaactcattaatatgtttccccatgatatataaacatataatttttcatgaaattttattcaattccatatttcactatattttatcttattctaatttaaatgtaaataattctatctcttaatagttgtcaaattttaagttgcaaaactcataaaaacttgctaatatttatattattattaaaaatattgtctaaaaaatttattttttagtttctttttaataactgattattagaatagtttttttcatataataatgtagtaatgatatcgtaatggagggttttaacatggaagataaaaaacgtaacattcttttctctgaagaacaaattaaagctagagtaaaggaacttggtgaagaaataacaaaagactatgaaggtagagaagtttatatattacctttattaagaggaagttttgtttttggagctgatatctttaaagctttagatttaaaagcaaaagttggattcatgacaacttcaagttatggcaatggtgaagttagtactggtactgtaactgttgttaatgatattccagataatatagaaggccttgatgtaataatagttgatgatattatcgatactggatatacaatggaatttgttataaaccacgtaaaaaaattaggtgctaagtctgttaaaacttgtgttttacttgataaaccttctagaagaaaagttgatttaaaacctgattattgctgctttgaaatagaggatttatttgtagttggttatggattagactacgaaggttactatagaaatgttccttatgtatttaactgggaaactaaataattaataaacatagttaaagctagtgattacaatgacttcactagcttttcattctcacttatcattaaaatttatacccaatttgtaccctttttctaaaaatatattaatttcccttttcatttacttcacgaccataaaattcttcattccaaatcttgattagttcactattcttttttagcctcctatatgaatcatttgctatctgctgaattcttgaaggaagtaacatttaacaaagaaagtaagctagaaatggagttgtatgactatctaattaaacaaagtaaattagtgtggaagggtaagcatattaaattacttatacaaaaataaaaggctggaaactgatccagccctttattttagaaccctaataaagtatatatatttctttgaacctcattatccattacttctaacatatcttctctatcatattcgtaccaatcttcggtaaatctaaaaaaatctttgtaatattcgctttgaataagatagtctgcttttgtataatcattcattaaatggccaactattctacaattttcattaacatctctaagcaacaaatcatatccacctataccttgaactactattcttttttcatcattaggaattgtattaaaattagaatctttaagctcaatagataataattcatcacttgaaaatactgctaatttaaaattataagaaccacattttgggcattcatcatgtctattgtcaaagaaagaaactccgcatttagtacaagttactaaataaccatcatcaccataaagtaattctgtgttttcttcattagttataatcccatcacctgttgttggatttgcttctgttctaaataatccatattcttctgtatattctgttttagcatcggttttatgatagtcaacagcaataaaaattccgtaaattatcattatagcacttaatattatagctattactcctattgcaaaaatacttttttctttaacactttgtttcataaataaatcccccttctatcttaataaccaactgaacttaatccatattgaatttgttcttcttgagttggttctgaaacattgttaacttcgttatttgttctatttttttctattgtattttttagttcttccattgtgttttttacttctttgtcagtaaagttttgttcttctaaatagcttcttatattcctgattcctcatctttcatcataatattggttttcagctattatacaagcaatatcttgcctgtctatatttgattcatttacagcttctttaataacatccaatgaataacccttaacgtaaaggtctctttgtaatgcagcaggagtagcatacccccttaactttccacttcttaaagttttagcaatataactttcattcagaatatctctatcttctccaattattcccacttaaatcgctttatgtccctctcaaatgtttatattattttttctgttacactttatttataaatatttttcaataatgctttgagttcccatatcctcaagcccatctttagctaattcctcatacatttcaagtactttattaagtataggaagattttctcctttttcatccattacttccttagcaattttcatatcttttataaaatgcttattgaaaaatcctggtgcataatctttttcaatcatcttatatccattattttgcatctgccagcttcctgctgcccccttagatatagcatctaaaacagttttcgtattaagtcctaccttttttgcataaataatagattctgccacagctgcaactgttcctgctatggcaatttgattgcaagccttacaattttgaccacttcctatttccccaagataaattatatttttacctaaacattcaaataaaccatacatttcatcaaaatcttttttatctccaccgaccattattgataaagttgcattctttgctccaatatcgccaccagaaacaggcgcatctaaaatattaaacttctcacctaaatcatatattttcttagccaataatggtgatgaagttgtcatatcaattaaatatgtaccttcttttgcgtatttaaatataccttcttcacctaaatatacttcttcaacgtcctttggatatcctacaatagtgaatactacatctgcattttctacacattctttaatagtacttgtaactgtaattccaaattcttttaaaggttcacacttagaaattgttctgctaaaagcaaaaacattatgtccatttttagctaagtttattgccatataacttcccatgacccctattcctatccatgctatattcacatttccaatcctcctttttatttccatttttatttccttttttattatatgtcataaatttcattaaatcaatttagtaattaaataataaatttaattagaacttaaaatcatattcaaatttattatttaatttaatatactacattttttataaccaaatatatgtatatctcttaaaaataaaaaagtggattacaccacttttttatttttaattagatccattcatatttattgctgtgtctggaatttttcctactattatagtatcagaaattggaatttgagttgtaacttctatttcatcactatggaatggtacaacaactcttatttttgcctctacatttaaataaattttatgtcttgtttgattaattcctgcactttcaaattctgattcatatgatgtagttatattacctacttgttgcatttttactgtaattttaggtcctatgttataaaacataatattattagttaaataccctaatggtattttaacccccaaatcaccaagttcagataacttttcatcacaatttaatacaacttgagacgctaaataattttgcttagcagtatctgctcttatcatagttatatttccttcactatctttttctatatttataatatcctcataattaaaattatcagaaaaaaccttaacactttcttcatttataattcttactgcttcagacttcatcttaacttcgccaacactaagtacagatgttaatatccttttgctaaacatataaaaaactccattaaacaacataataagcaaaacaattattaacagtccatatggaaatttacttcgcttagtagctattttataatgatatttaggtttttttgtataatacttcatactctcaccctaatagttattattttactattacaattaatatgctataattgaatagaatattatattttatataaataaaaggaggaactaatggctaaagattctaataaatcaaaaagtccaaaagaaaaagtagttaaaacaaaaaacaagaaaaaaaccttaaaaaagaagccatctaaaattaaaagattttttaaatactttttccttacaatattaattctaggattattaatcggtgttgtaggcgttggatatgtagtcgctgtaattaaaacaacaccttcattagatgtaaatgctatttataatttaaatcaaccatcaatggtatatgatgatcaaggtgaatttatagatgacgtaccatcaactgaaatcagatatattatttcttatgatgagatgcctcaaaatttaattaatgcatatatatcaatagaagatgaacgttttatgagtcatggtggtattgatattaagagaattttaggcgctgctgccagagatgtaatggttatattaggtaagcaaaatggaatacatggtgcttctactattactcagcaattaataaaaaatactcttttatcatcagaagctgctacagagtcaagtccgatagatcgaattaatagaaaaataaaagaaatagttttagctgttcaattagataaagaattaagcaaagaagaaattattagaacttatttaaatactatccctttaagtggtcatatttatggtgtagaagctgcttcaaaatatttctttggtaaaagtgctaaagatcttacactacttgaatgtgcttatattgcaggtattacccaagcccctactacttatagtgcttataataccggtgcttcaaattatcctaatggatatattaacagaactaaaacagtgttaaataaaatgcttgagttaggctatatttctcaagaagaatttgatgttgcttatgctgatgctgaagctaataactttaatttcaaaaaactaaataccgattctcaagtaaatcatgaatggtttgtatatcctgccattgaacaagtaaaagatgatttaattgaaaagtacaagtatacagaagacgaagcaaaaaaattattagtaaacggcggattaaaaatttacactacactaaatgttgaaatgcaaaatgcagtacaagaaatattaaatgatagaacaaacttacaagtagatgatacttctgttgatgaaactgacagttacggtgttccattattacaagcatcagctacaataatagattataaaactggtcaagttaaagcacttgtgggaggtcgtggagatcaaccaccaacttcacttaatagagcttattctgatctaaaatctatcggttcaactactaaaccattaacagtttatggacctgcaattgatacaaaactaataactgcaggtactccacttgatgatacttcagtttctgatgaaatacttaagaagtataattttggatctgtaatacctaaaaatgctaatggctctatggctggatatgttactgcaagagaatcgttaacatattcaaaaaatctaacatcaattaagactgtagatatgctaggtttagatactgctatagattatggtgaaaaatctggtcttaaatatgcacctgaatctcatacaatgtcagcattagcacttggtcaatttgaacaaccaacaggaaatagagatggtggtaatactactattttagcttcagcatatggtgctttaggaaataatggtgtaagatatgagccaatactttacactagggtcgaagatgctagtggtaatgtattattagaaaatgaacctgaggcaattaatttattctcacctcaaacatcatatattctttatgatattttaaaaggttcttctagtagtgcagaatttagtgatattcctgtggctggtaaaacaggtacaactaactcttccgataatttctggtttgctggagtaactccatactattctggatctgtttggattggatatgatgctccaaagagaatgagtggtaagagctctagcgctgcatctttatttggaaaaataatggctgtagctcatgaaggcttagaatatacagatatagaagctccttctggtctagttcaagctactgtttgtaaggattctggtaagtctcctactgacttatgctaccaggaccaaagaggtaacagagttaaaactgaatactttattaaaggaactgagccaaaatcagtatgcgatgttcacgttagtattgctgtaaatagctcaaataacaaattagctactaaaaatactcctgcaagccttctagtaaataaagtatttatcaaaaaacctaatgcaaatccaaatgcagatgattatccttttgttgtaccaactgaagaagataatacaaaagcagaagaatatattgacttatctcaaatagggttaagagcaaatatggatttattagatgctattgttatattaaataacagaggaattaaatactcattcgatggtctttcagtttctggtaatattacatcaggacaatacacactagtttcatatacagaaaaaattaaatctggtgaaactgtagagcttaaaataaaagctactactaatactcctgatgaggatattggtaataacgatgatactaacgatactactaatgatgatgctactactactcctgactctgatacagatgcacaaagaaactctataacagatataataaacggaatatttaattaataaaaaataaaggcagtacgaagtactgcttttattttttagttttatgaattttatcctgcatctatattcatttttttcaataataatatcatttttgtattttaaaagtgcttttttgaataattcaatctcccttcttgcatttttcttttttttattgtatactatagaaaagaactggaattatcttataattaagggggaaaatatatggattttataaatgagtttatcttatctattaatgattttatttggacttatattcttattgcaatgctcttaacaatcggagtatatttcacatttaaaactaaatttgttcaatttactaattttaaagagatgtttaaattacttagtgaaagtactaattcaaaaggaaaaactaaaggacaagtctcttcattccaagcattttgtataggtactgcttcgagagttggtactggtaatttagctggtgttgcttctgcaattgctataggtggtcctggagccgttttttggatgtggcttattgcactaattggttcagcttcagccttcattgaatcaactttagctcaaatctataaagtaaaagatggtgatagctttagaggtggccctgcatactatatggaaaagggattaaagaaaaaatggatgggtgtatcattctctgttcttattattgtttgctttggatttgcatttaactctgttcaatctaacacaattgcagctgcctttaattcatcatttaatgcaaacaaattactaatcggtattatattaacagtgttaacattaataataatatttggtggagtaaatagaatagctaaaatttcaagtattttagttccagtaatggctgttgcttatatagttattgcattattcattatagtgattaacttcaaagaaatacctaacttattcaaaacaatatttgaaagcgcttttggatttaagcaagtagttggtggtggtataggtgctgctttattacaaggtataaaaagaggtttattctctaacgaagctggtatgggatctgctccaaatgcagcagctactgctacagtatctcaccctgtaaaacaaggattaattcaaactttaggagtatttactgatacattaattatttgtacttctacagcttttattattctattatcaggagcgccattagatggatcagtaaaaggaatagaacttactcaaatggcattaatttctcaagttggttcttggggtggaacatttataactatttgtatattattatttgctttcagttcaattataggtaattactattatggtgaaactaatatacaatttatctctgataagaagatatacttatatatctatagaatcttagttgctgcaatggttctatttggatcaattgcatcaatggatttagtttggaacttggctgacgtatttatgggcttaatggctatcttaaacttaattgcaatagtaatgttaagtaagattgctatatctgcatttaatgattatatagctcaaaagaaagccggaaaagatcctgtattctatgcctcttctataaaagaacttggtgacgaagttgaagaatggcaaaaagatgatcaagaatatatagcataaagaaaagctttatcaaaacctaagttttgataaagcttttttagcaactactaaatacacttatgcataatgttatatgtatttattttttcttatcccccactgcacaatttgaattactccgaactaaatagcatcttaaataaactaatctgtttataactatatgtaaattatgtaatatttactgtataattgtactgtattacaaaaatgggtcatatatacggatttcggcgaatcaataggcaatatattatcatatgcattattaattttttactatagtatttattttttatttattaaaattactgttaaacatactataatatcacttttacctaatttgaagtcagagctcaaagagtacatttctgaaacaataaaaaaatgtgaaattgataaaaataaaataacttttactaatacactattaaaatagagctataaatgtatttacatctatagctctattttatgttactttatattattcctactatttcattaatatctttaataccttgttctctgcagaatgcttccatttcttcaataatttcttttcctgccattggattaaagaagttcactgttcctatttgaattgctgatgcacctgccatcatgaattctatagcatctaaccctgttgttattccacctaaacctattataggtatttccactgccttagcaacttcatgaaccattcttagagctactggcttaactgctggccctgatacccctgcatatacattattaaatacagcttttctcttatatggatctattgctaacccctttaatgtattaataagagataacgaatctgctcctgcttcttgacatttaatagccatatctactatatcctctgcattaggagataacttaaccataagtggcttatcaactatttctttagctttcttaacaacttcataagcaacttctgatttaattccaaaagccattcctccactctttacattaggacatgatatattaagctctatcatatcaatatctgttcctctaagtttttctaatgcaatttcataatcttccatacatccgccaccaacatttgcaataatgttagttcctaatgctttcatctttggaagttcttctgctataaatctatctattcctggattttgaagtccaactgaattcatcattcctgatggtgtttcaaacactcttattccatcatttcctgccttttcatttaaagttaatcctttcgatgaaataccacctaaaattcctacatcataaaaattattatattctgctccaaaaccaaaggttcctgatgctgctattactgggtttttaaaatctaatccatttatattaacttttaacattttatcttctcctttggtctattatagttctacatagtatccatcaaataccggaccatctttacaagttcttttatttccatctttagtcttacaagtacacactaaacatgcccctacgccacaagccatatgtttttccattgaaacatatacttttacttgcttttctttacacatttctacaactcttttcatcataacttcaggaccgcaacataatactgtatcatatttatctaaatctaatatttctgttacaaatcccttatgcccatatttccctgtattcgtagaaacaaagcttttatcaacaaattcatttatttcatctattaaatacacatcatctctaaaccctgcataaagatccatttttatatctttatttttttctcttagccttttagaaagctctaacattggcgctgtaccaattcctccacttactaatgcaactctcccatagtcctcttctaagttaaatccattacctaaaggtccatttaaacttattgtatctcccacttttaattctgcatattccttagtcccagcacctacaacagcataaacaaaagttagtgtttccccattagtttcacatacacttataggtcttggaagaagagttgctccattatgcttaagcatataaaactgacctgcttttgcttcattcttatcttccacaatcatcttaaagattccattttgaatttcttgatttaataatacttttccttgtgtgtacttcataaactccatcctcctaaagactattaactgcgtttcttatttcatctctcattcttatagcttctcttcttgcacaagcagcaaattcttctggtttattttcctttttatatgctaaaagaatagctcttgatgagtttacaactccaccatttccatctcttaagtataaagctacatcttctgcctttccaccttgtgcaccatatccaggtattaagaaaaacatatctttatatctttctcttatttcctttccttcttcaacatgagtacatccaataactccacctattgctgaatatccacattcgccttttacagcttcacccatcttagtaagcttatcacctacaactttataaaccttactattatcttttgtatctatattttctatatcttcagcacctggatttgaagttctaactagtacgaaaacacccttatttccactttccatatatggcatatatggttctatactatccattcccatatatggacttaatgtaataaaatctgcttcaaaatctccactaaaatgccctttagcatattgagttgcagttgccattatgtctcctctttttatatctgcaattataatagcatctctttctcttaaatattctaatgttttcttatatgctataagaccagctaatcctaaagcttcataatatgctatttgaactttaaagcatgctacaacatctaaagtttcatctataattgctttattatattcaactattgcttcttctactgatcttccttctaaaatatgtttaggtatgtattcaacagcagtatctaatcctaagcatactactcctctttcttcaactcttttatataatttatccattattaaacttttcatttttaatttcacctttctacacttatgataacattaaacttctttactatatattacttttccgcctcttatagtctttataacttctccaaagtattttcttccttggaaaggagtattcttacctttagatacaaatgtttctttatcaactattacttccttatttaaatcaactaatactaaatctccatcttttccaacattaactgttcctttgttcattttaagtatattagccggatttttagacattaattcacttaatttatttatagaaatattgttattttttactaattctgtatagcaaatactaaatgcagtttctaatcctaccattcctggagcacccttttgcttatcttcctcagtatgaggagcatggtctgtccctatgcagtcaacagttccatctttaattccgtctactattgcattaacatcttctttttcccttattggaggatttactctataattgcttatatctgttgttaatcctatatgatgtggtgtaacctcacaagttacatttccaccttcatttttagttcttcttattgcattaattgattcaactgtacttacatgagccatatgtaatcttgcacctgttactttagctaaatataaatctcttatagtcattaaatcttctgcaattctcatatctattttagaaaatgttttatcttcagcatgagacattataatccaattattttcttttgctttttgcatagctttcatcataacacttgagtccataaccccaacgccatcatcagttatagccactagttctttatcatcattaaaagcctctaagtgctctatagactttccacaaaagttttctgtaattgatacacattgatgaacatcaattaatccaacttctttagctctatttctaacatactctactacttcctttgttgagcaaatcggattagtatttcccattaagcatactccagtatatcctccttttgctgcagctttagaaccactttctatatcttccttatgagttaaccctggttctctaaagtgagcatgagtatctataaaagatggcatcactgtatatccttttgcatcaatcacttcaataccatctttatttatttctttaccaatttgatttattactccatctattattaatatatcaccttgaaaattttcatttgcatctatcacgtcagcattctttattaataaattcataacttttatacctcacttggatttataatttgttcacaatattcacatttatagcttcctttttctctatctaataacttaaagctatgtggtatataactttctactgaagtaatacaattaggattttcacatattaatatatcttgaacttcttcaggaagttctggtttaatcttactaacaataacctcatctctcacttcatttattgtgatacctggagaaagtaacccaagcacagtataatttattttttctaaattttcaatttttattatatcttttttccccatctttttactatcagcatttataattaatgctacttgatgtccaagttcatctaactttaaatatctaaatattttaacacccataccagcttttatatgatctaacataaatccattttttatactagttatttgtagcattacattacctccaacaacttaactattaaagccattcttacatacattccatattctgcttgtctaaaatatactgctctgtcatcactatcaacttctgttgcaatttcatttacccttggaagtggatgcattactatcatatctgactttgcctttttcattttttcattatctaatatataacaatcctttaatcttaaatattcttcttcattaaagaacctttccttttgaattcttgtcatatataatatgtctaattctccgattacttcttctatattttctacttctctaaaagatatattatttctttttagtacttcttctcttatatattctggaattaccaattcttttggtgatataagtatgaatttagtatctttatatctagacatagccatgattaaagactgaactgtacgtccgttttttaagtcaccacataatccaattgtatgtccttctaatgtttctttttgtgatttaatagttaacaaatctgttaatgtttgagttggatgttgatgcccaccatctcctgcatttataactggaactgatgaatacatgcttgcgacctttgctgacccttccttaggatgtctcattgcaattatatctgaataaattgaaaccattcttatagtatctgctaatgtttctccttttgcactagagcttgagtttggttcggaaaaccccaatattttccctcctaatctcatcatagcagcttcgaaactaaaacgagttcttgtacttggttcataaaaaagtgcggctaagattttaccatcacagatgtgcgaaaattcttttggatttgaaattattttttcagctaattcaaaaatttcattaagctcctctttagaaaaatccatggggcttattaaatgtttatttatcatttatagtcactcctttttaacatcactgtgttaaatttaaagaatacaaaaaaccttccttaaaatttaaggaaggtatagtaatcttataatatgggtattattacaacttccttatgaatctctcggattcctttaaaggttcttttttgttagaataacattacattcaaattttgtcaatgcaatttaattccagttgttcattaccccatcccacatcattttaccacatttcgctaaagatactgttccataaacactatttggtatatcttcagataatacagtaaatgtaaattttccttttggtaattctaaatatgcagtatcattctcgacaccctttttatctccagttttacttgatatttctatttttaaatcatcaggaatgtataatgctaacttatttttaatttgttgtcttcttaatatatctataagcatctgaccattatcttttgataagaatgttccattggctaaatgtttccatatccttgataaatcatatgcagtagttatattttcaacatcagtaattacaatcctttcatcattcgtttttctatttaatcttgtattctttaatcccatagcaattatatcttcattaatctgttccattccaactatatctataattttatttgctgcagtattatcgctttgtattagcattattacaagaagctcaaatactgtatattctctttcattaaattcatgaataattcctgttccgtaaaccttatctccactttggattttaactttatccataaagtctactttcttatcttctaccgctttaattaacgaaacagctattggaagtttcatacatcctgcggcagtcatagaaacgttttcattgtatccatacacataaccactttttaaatcttcaaaaaagaaactatatttcccgattcttgattctaaatatttctttatttctttcataataccctcctaaatccactgattcaataaatttctcttgctttaatataagtatatcatattgtcagaatattttgaagtattcctttaaatttttttccatttttgtacactcatcaaatctatctaacttatttttaatacttatagtcttaattttaaaaatagtgacaattctgcaaaaaataattgtacattataaaatcattttttgcatttgtcactatttatatactttaatatttacttattattcagcaaaagaaattcctatctttttagcaacttgtactaattctccctctggatttactttcttagtattttgccctattacattttctaatgtatcactagtgatagtatctccttttaaacaaaccattcttccaaactttccttccatcattaattcaacagctgctacaccgtatcttgttgaaagaattctatcataagtagaagtattaccccctctttgaacatgtcctaaaacagtacatcttacttcatgttctttaattagcttttctaaatcatcagctaacttattacctattccgcctaatcttattggatctggactatctgcaactattttagatactacaatatctccatctttaggtttcgcaccttccgctactactattatagtaaagtttcttccttccgcttctctttcttttacttttgctgcaattttattaatatcatatggtatttctggtaaaagaattacatctgctgaacctgctatccctgattctaatgctatccatcctgcatttcttcccattacttcacaaagcatgattctatgatgtgattctgctgttgtatgaagtctatctaaagcttctgtaaccacatctattgcagtattaaatccaaatgtcacatcagtagatgctaaatcattatctatagttttaggaacacctattacattgataccttttctagcaaaatctctagctgatgttaatgttccatcaccgccaattacaactaaaacatcaataccttctttttttagattttcaactgctacatcagatacatctttttttaccattaccccattttcttcaacgagataatcaaataaattatctttatttgaactataaagaatggtacctcctctatgtagtataccagctactgaatctaagtttaaagaaacaaaatcattattatataatcctctatatccaaatttataccctattacttcgataccataatttaatattgctgtttttgttacggctctaattacggcattcaggcctggacaatctccaccacctgttaataacgctatttttttaattttttgttccattttaaattcctccctacccatctacttaaactaataacctttcagcattttttccttatagcctacctattactacatagtttttcataaaattcagaatatttcctcttataatataatatcatatattcaaataactggaaagggtttttttcaatttgtacttttctacaaaaataaatgagagatagtatttacactatctctcatttttactaatatgctaattctaatccttgaacatctattgttatattttcatcattaacatacttatcgtatacttttttaattgcattataattatttgtaattaattcttttgatgcgctatctatggaacttggcatatcattgtatgctgattcaatatttgaatatgctctccatacatctttatctactgtaatgtaataacatgctgcattatttaatgctaaaatatctttttcgttcaatgaatatgcttttcttatattttcaatagctttatcatattctttttcattatagtaaatagcacctaaagctctgtaataatctccattatctttatcgatatctattgctttatttaactctaaaattgcatcatcaacttttcctatatctaggtttagtaatgctaaatcataatatacttcggtgttatttttattcaacgttaacgcataatcgtaataatacttagccttctctaaatcaagcaatttagcttcatataatttagcaatattcataattaaattataattatatggttcattaaatatagctattctaatataactttcaattttatctgaattttctgtatcaattaatatattaggcattaatattccataagtattttcatactgctgattagccaatatagcttcattagcaaattcttttgctttatcatattgacctttactatagttatcccaagccttactatataaatctacatatgaatcttcttctaattcatcagtatttatattattttttatttcgttaatcacatttttactaaaatcaatatcatttttatcaaatgaattaattaaattaatccaaattttataaacttcaacttttggattttcttctgataattctgttacttccttcaataacttttctttatcagattgacaaacttccattataacatcatataattttatttcattcttatcaatttcatatgaaagtcttaagttttctaaaccattatcataatcattaatcattatttgcatcttagctaaagtagctaaatcataagcactatccttatcaactggataagagtttactattccttttgctaagtctttttgatcatttgccaaataaatagcaaacattgtttttaataaaggtttatatgtattataagtttctaaataatattcaccaaaactttctgcttgctctaactcattattcatataaaaagtgaatactacttcattaattaattctttatcctgttctaaatactcatctccgctttcaagtattaacttatctctttttactatcgcttctttcaataagttatttgattgagttgtatcgccttggatagagtatatttcagctgctcttacagtccaaattggccatgcatcttctttttgcattgtcatatattcatttatagcttcatcatacttaccatcgtagtaatattcttctgctttattattcgttattgtaattgtctttgttcccatcatgctttgtattgatattaacactacaaaagcaaataaaatagaaagacttatcgtaattattggttcaacatatttgtttttatttgacttcttactaacatttaaggagtcattttttttgttttccataatccctccatttgtttaataaatattcctaacaataattctaacaaaaaattagttttttttcaaatattaatttatgaattcgatatttcccactaatttatgtaattaaaaatggcaaattattaaatactttatttttaattaattaatttgccattattagataaaattattgtcttttttttactaatctattttctattacagctactatctcgtacattataaaggcaattacagataaaattactatactcatcataaccatatctaattgagctatttgcccaccatatattattaagaaccctaatccttctcttgcaaccaaaaattctcccatgataactccaacccaagaaagtccaacatttatttttaatgcagaaatgataactggtacagaagctgggaaaactaaatatcttaatttttgccactttgatgcttgaaaggtagtcattaatagcatttttcctttatctacttcattaaaccctgttaaaacacttattattgttgtaacaattgaaattagcaatgctattgttatgattgctgatgtaccatttccaacccaaaagataattattggagcaagtgctacttttggtaatgcatttaatactactaaataaggatcaagtacttctgatgctgtttttgatgcccataataatattgcaattgctactcctaaaaccgtacctagcgtaaatccaattatagtttcataacaagttacccatatatgcctaaataatgtaccttcatttataaagctaactaatgattttataattctactgggacttgaagttaaaaatggatctatccactttaattgtgcggcaatttcccatagtgcaataaatgctactagaattaatgctcttattattcttactttccacttatccctcttaactttttttaaatacaattcatgttctttttccatactaattatccaactccccccataactttctaaagtactcattgtactctggttcctttcttttatcgaaaggagttgcatctttattcttaaattctatatttacatcatcttttatataagctggcctagaagttaaaattattactcttttggacattacgatagcctcacctaaatcatgtgttaccattattgctgttttcttttccttcttaattatctcataaacatcatctgtcatttttaatctactttgataatctaatgcagaaaatggttcatcaagcaatagtatttcgggtcttaaaactaaggttctaattaaagctaccctttgtctcataccaccagataattgtgttggcttatgcgactgaaatttttccaacccataactttttagtaattcatctgcaaattctatgttttcttttgtatatattttcttaactttaagccctaataatacattttctctaacagataaccatggaaacaaataatctttttgaaacatatatcccattttatctagattatttttcacatctggatcattaaatttaatttctccacttgatggagttaatatcccacttattatattaagcaatgttgattttccacaccctgacggaccaattatacttataaattcaccatcatcaactgaaaagctaatatttttaatcgcttctgtaactccttccatagtatgatagttcatatttatattccttatttctaagagactcactttaccaccaccccataataattttatagttatagttagtagttatttgtttattttcttaaattaatttttctaatttttaactactaactaaactatttatagtattagcttattttgttgcctcttctgcaaaggagttatttacaatcacattaaaatctggtcttgtttggatcaagcttgaatcatatccttgtataatatccattagtttatttaaaccatcttcacttacttcaggagtttctgaaaatgcatctatactcttataattgtctattactttaactattacatctttgtcagttcctgggaaaaatgaactaatagagtcagcaatttcttcacttgtatgttgttgaacccataattgacctttgtaaattgcatttgtaaatttttgaattatttctggatttttatccatatatgatttagttgtatagaaacaagtataagcaatatttcctgcttgttctcctactgaagaaactatactaccaccaccatcattttctaacattgtagcagttggctcaaacaatgcaacataatcgccagtgccagatttgaaagcacctgcagtagctgtaaaatcaacattagtaaccatgcttacatcattttcaggatctaatccattttcttttagtacatactcaagggccatttctggaattccacctggtctaccacctattatttctttacctttcaatgttgaccaatcaaaattttcttcagctgctcttccaactaagaatgagccatctttttgtgttaattgtccaaatacaactggataatcttctcttccttgattataaatataaacaacttgttctggtcctgaaaagcctatatctgcgtttccacttaataattgttgcatagttttatctgcaccttgacctgtagataaatcaacatcaagtccctcttcttcaaaaaaaccttgacttattgcaacatacattggagcataaaatacagatcttacaacttcatttaatctaacagtttgtaactttgtatcatcagtactttcttttgatgaattatttttcccacaaccaataaatgtagatcctactaaagcaactatactgaatatagctgcaaaacgtttaaaagttttattcatacctactcctttttagataaaattgtttatattattatgatttatattatgatatatgattattttttgttaatttctgcaatcgtttcatctatttatttttcataatttcaaagatttctctattataaaacatacttcttaccatatagacataacattactttatattatattatataacaataaactttttaaattttatacttagatttataaggaggattactcatgaaattttttagagaatcaattttgatcctttcaatttattttgctggtgaaatcatttcaggactatttcatattcctattccaggaaacattattggaatgatattgctatttttattattaacttctaatatattaaaagttgaaaaggttgaaacactttctaacttcttcttagatcatttagcttttttctttattcctgcatcggtaggattaatgacttcatttagtgatctaaaaggcagtatattaaaaatagttttattatgtatactaacaacaataatcgtattatcagttacagcactcactgtagaatttatttgcaagaaaaaacaaaaatcagcaaatgataatggcgataaacttactaaaaaggagtcataaacaaatggatatatttacaaataacatgttttttggaatatttatatctcttatagcatttgaaataggtttatttatttataaaaaaaccaaatttccactttttaacccacttttaattgctacaataatcgtaataggctttttaaagatatttaatatagattttgacacttacaatcaaggtggtcaatttataaatatttttcttggacctgcaacagtggttctagctgttccattatataaaaaccttaatttacttaaagaaaactttcttcctattttttcgggaatattcgtaggtagtttagttagtgtattatctgttatttcaatttcttttttcttaggattagataatagtctaacaatttcattgttagctaaaagtgtaacaactccaataggaatagaaattacaaatacacttggtggtgttacttcaatcactgttttagctattatattatctggaataataggagcaattgtaggtcctaccgtctttaaaatattaagaattaatagtccaattgctagaggtatttcattaggaacttcttctcatgctgttggaacttcaaaagccttagaaattggagaacaagaaggtgccatgagttcattatctatcggagttgctggtataataacagtatttttagcacctctatgttattctctgctttcaatactaattaaataaatttatataaaataagtcatagtatctgctgattactatgacttattttatataaatttattcaatctaattaatacatttcaattatatattttatagaaatatatattatgataaaatattaacataatgttaaataatattatatatgttatcatcttagtaattattaacatagtataatattatatattacgaggtatataatgactttaaaaaacataattcacaaacttggtaatactgaaaatgctgaagaatttattttaaatctttgcaataaaattcgcaatttaaatcctaaaaaagctataaaaatctatgattatttaatagcatatacaatagaaaatggattaaataaagtttatccaaacatactttataattatagttggattcaatatgacttagggaattttgatgttgctataaagttaaatcttaaagctataactttattcaaggagcaagctgatgatgatggagtcctatcttcaatagctttacttattgggctttatagtaattgccaaagatttgataaagccattgaatatgcaaatataggaatagacttagctgaatctaccggtaactttcaaagattatgttcaataaaaagtacaatgggaattctttatttagaaatagaacaatattccgaagcagaggatatatttaaaaaagccttaagactacctaatgtaggaaacaaaactaatgaattatctatgctagttaacttaagcgaatgccaaattgaacgtaaattatatgatgaagccttgattaatttaaaaaaggctttacctttagcaaaacaacatagaataagtgtagttccatatatatattttctatcagctcgtatatatacagaaacggatatttatgatcttgcagaggaaaaatttgaagaaagtattaaactatgtatagatggaaactattcactctttctaaatgatacatatatattttggtcagatttagctttaaaacaaaaaaaatacactgaaattattaataaattgaaaaatattgaaggaaatatagttaatgtaagttcattaagaaatatgagacgactttataaaaatctacatttatcttataggaatcttaataactatgaaaatgcatattactacttagaaaagcttaataatctagaaaatgatttttctaatagaaaattagaaagtattaaaataataagtaagaccgttcaaaatgaagaaaataaaatatataaaacactctttaatgaaactgaagctctatatacaataggccagaagctagcttcttctttaaaacttgaaaacatttatagtattttagagaaagaagtcaatactttatttgattttgatatattatcaattggtataattaataataactctattaaatatgaacttagtgtagagtttggtaaaagagtagaaattgcttcttcttcattagataaaatatgcttaggaatttattcggttaaaaacaagcaagatatcttaattaacgatatttctaaggattgtaacaaatatttacataattataatgaactattaaagtactcttcctatagtcaaacaagttcaatcacaacttctacacaatccatgatatttgttccaattattgcaagtaaagatgtaataggtatattaacaatacaatcctactgtaaaaacaaatatgacttaaatgatgtaaataaattaaaaataatttcaaattatttaggaattgctttagttaattcacactattataatgaaatacaatacaatgcaaattatgatatgctaacaaaaatatataatagacgaactgttttagataaaattcaaaaatcatatactgaattaaagctacttaaagaaatggctattactaatatatctagtaatgattcaaagctaactattaacgaagataataaatatttagtgttaatagatatcgataacttcaaaaaaatcaatgatacttatggtcaccaaacaggcgatgatgttcttatatctatttcaagtaccttaagaaagtctattggcgacaacgatgttttaggacgatatggtggtgaagaatttattgctcttattaatgattgtaataataattacttagaaactttagacaatatacgtaaaaacatagaaaacctttttatcaaatatacagaaaataatgttgaaaacaatatcaatgttaccgctagctttggtgtagcaaaattaaatccatctaaaatgactttaaaagaaataattaatattgctgacaaagctctatataaggctaaaactctgggaaaaaacagagtaattattgcaaaagatatttaataaaaaaagctttagcagctaaatactgccaaagctttttttaatttataaattcaaatttccaattgtaatatcctgttttttcatctttttcatatcttaaatacgcagaaaataaagttccttttttacttttaagatttctaaatccaaccttaccattcttaagaagtagttgaaccatctcctttgttacttttttacctagggattcaataaatttatcatttttccaaatagtatatttacaaccatttttccaattaacacacccatatcccttttcgccttctataattgaatttccacatacaggacatttaccaatttcctctaccccttcaggcttttcaactttaaacttatgaagcattgagctatcatttttaatcttctccactgaacttcttgtaaaatcataaattaaatttaaaaaatcctcttttttaaattttcctctttcaatatcagataatgttttctcaagccttccagtatattctaggtctaaaagctcttttgctgggaaaatttctactatggttcttccaagttctgttgtagttaggctttttcctttagttttgatatatccaatatcctttagcttctttatagtttcagctctagtagctggagttccaatactaaaaccacttaaaatagcttgcatcatttcttccgaattactctcatcatctgaactttcgtctttatcatctttaaatgactttccacaagtctccattactcttaaaagtgttttttctgtatggtacttaggtggcttctttgtcactttgttaaccttgctatcaattatagctaagctttcattcttttcaactaaaggtaaaattgtatccttagtttctattttctcaactactctccatcctttaactatttctaccttccctttagaaacaaattcaccttttatttgttcatcatgaacctttaaagttatttttgtttcttcaaactgcgcaacaggcataaattgcattataaatctattttttatagcattataaacatgttgttcctctgtacttaatccctttggtattacatatgtaggagtaatagcactatggctctcaaccttagaattatcaaaaactcttttagattgaatgaattttatttgatcctcataaggcaacccctttttatgggtctcaagaaccttttttgccttatcaactaaactttcttctaaaacactgcttgcagttctaggatatgttataagtttcttttcatataacccttgtgccacctttaacaccttatcagaagtccagcctttatacttactagttatatatccttgcaaatttgaaaggttaaaaagactttgtggatattcccttttcttttcaatttctttttctacaactactgcttgtttttctttcaataatttacttaaattgtctaagtactcttttttctcaaacttttcagaagcattttcataataaagactttcaaattctatattatctttagatttcaaattaattaataacttataatatgaagactccttaaagttttcaatttctttatctctatcataaattatctttaaagtaggtaataaaactctccctatattaattgtctttttttcacttgcaccatatcttaatgttgcaacagacgtcaaattaatacctattgtccaatccgccaactgccttcctattccagcatcttgaagtggtttcatttcactattaagctttaaatttgacattcctttcttaacttcatcttctgtccattcattaagaagaagtctataaataggcttttttatatcataatggataaataattcatctgaaataacctgaccttctctatcaaagtctgttgcagaaattaccccatcaacatcatctctgtcaattaatcctttaataatatttatttgtttttctgcacccttatcaacaacttccctattactactatcacattttattttatacttaaaaccttcaggaataaaagggaatttatccattctccatcccttcatattttcatcataatcctttgcatcatacaattgaagtaaatgaccaaaagcccaagtaactaaataatcgtcgccttcataaaacccatctcttctagtttttattttatatgcatccgctatatttttagcaactgatggtttttctgctattattactttcttcaaaatactcttctccttaaattcgtatttacatcattaccagatttatattttatcctatttatttttataattcaaactttattaattacatttcattaaatatccaaatataaaatgataaatatcctgcaaatagaatccataaaatgtaaggtatcatcaatattcccgatatcctatcatttttaaagaatttaattgtagttatgattataagtattaataaaatacttattaatataaatgaaataccatataaccttaaattaaaaaatataattgcccacaaaaaacttattaaaagctgtactaaataatcaaaatatcccccatgatcatcttttccttgcttattatgcatatatattctataagcagcaattcccattaaagtatataaaacaatccacactatcctaaaaactaaattaggcggtgtaagaatacttttttttaatgcatcatatatattcattgaatttttagtaaaaaatcctactatcaaactcccaataacaggcatcataatattttttaataaacctataaattcaaactttccattaacgcaaaatatctctttaaatatattctttcttctattaaccgactttttaactttaggtttcttcttttttctcacaaacatcaccccttttatttactaataaaatatatgttgcttaacagtaaataatgtttatgagtaatataatttttaatttgtcactttttcattaacatttacgattctattcgtccaatttaatatatgtaaaataacttcatctttattactttcatttagcatttcatgtctaccattcttatataatttatatttcaagtcatgtatccctaattctttatagcattcatataatctttttatacctttaccgaaatctccaactggatctttatcaccagcaaaaattaatactggtaaatctttagggattaattctaagttttcttttttattaatcttccataatcctcttattaaatcataataatatgatgtcgtacaaataaatccacaataatcgtcttctatatatttgtccacttcctcatcaacagagcatagccaatcataatttgttctattaggtttaaaacttctattaaagtttccaaatgataacttgtccatcatcttactcttggcttttcttcctcttatcatcatttcaacttttgaaattaatattcctaattttgttatgtaatcaggtcttccatttgttcccgataatattactccatctaattctttaccatacaattcaatatatctttgacttacgaaagaacccatgctatgcccaaataatattaaaggtaactcctcattttctttttttattatatctgtaagctctttaacattttcaacaagcatatcaaaaccttcattattagctatatatcctctttcttcatcctccttagaagtttctccatgtcctctatgatcatgtgcatataccataaatccatgttctataagcttatttgcaaaataatcatatctacaagcatactcagtcattccatgtgaaatctgtattattccctttacctcacctttaacttcccacttataacatttaatttctttaccttctttgtcgataaacgaaaacttcttcaaaactatcatctcctatttagttttctaatatattatcttctcacacaaattcactgtcaatattttatagtggattgttaaacaattattcatatttatataatttatcctaaaattttttaatttaatttaaatatcctgttaagatgcatttgttaaaatgtaagtttatgatatactattttagtattgatataatctttatagtaatattataatttaacttataattggtcctctaaatccctaacctacacactaaatgtatactttaattaatgaaatttataccttaacaattttgttaatttcaattatataattttattattattaaattaataggttaaggaatttcctataatattacttttaaatgattatagttcaatattattgttaataatgtaaataaactattgtaggtggtgaagaaaattaatattaagtcaattctcagtatattagcaacaaagttcacattatttcttactaaaaccattttaaaaggtggtactacttttcctggtagagttgcattaaagttagataataatattttagcaactgtatctaaaggatataaagttgtattagttacaggaactaatggtaaaactactactacaagcatgatttataacatcattaaagaaaaaggttatccagtaataactaataacacaggggccaatctcttccctggtatagttactacttttgttgaaaactacaagttctttaataaggatgaaaataaatatgcaattatagaagtagatgaagctaatttaaaatttataacaaagtatattaatcctgaaataattactgtaacaaatttatttagggatcaacttgatagatatggagaagtttatactacattaactaaaattttagaaggtataactcttgtgccagaaagtaagctagtcttaaacggtgatgaatcattacttggaaagcttgatgtaaaaaacccattagttttttatggatttaaaacaccaataaatgaaaataaaactattgatgttaatgcagattcaaaattctgtaaattctgcaaaaccccttatagttataactttgttacatataatcatttaggagattattactgtacaggctgtggttatactcatccagctattaagtatggtgtagacgaaattgtagagttaacagctgaaagttctactgttaaatttggtaacactgaaattttcttaggtcaatctggtgtatataacatctataatgccctttgtgcttattcaatagcaaaagaacttaatattgatgatgcttgtataaaaaaatctttagaaaatcaaagttctagttttggaagacaagaaataataaatatagatgataaagaagcaaaaatcattttagttaaaaatcctgctggatataatcaagctttagataccctttgcttaaacaaagattctttctcttgtgtattcttactaaatgataattatgctgatggtagagatgtttcttggatttgggatgttaattttgaaaacttaaataatgtacctctagatgaagtttatatatcagggcttagaacttttgatatggcagtaagactaaaaacagctggtatttctccatctaagtttgttattgaagaggaatacgaaaacttaactgaacaaataaaaaatggtaaaaacaaaaaaatatatatccttgcaacttatacagcaatgataaattacagaaagtatttacattctaagggttatataaaaaacctttggtagtgtttaggaggctattatggaattaaatatttgtcacctttatccagacttattaaatgtatatggtgatgttggaaatatattaattttaaaacacagagctgaaaatcgtggaattaaagttaatataattaatgtttcaattaatgatgaatttaatgcagataattatgatatagtattttttggcggaggccaagattttgaacaatcaattgtatcttctgatttgatgaataataaaaaagcagaattatcaaggtatataaataacggtaaagttctaatagctatctgtggtggatatcaattattaggtaaattctatactgctcctaatggtgaaagaatcgaaggcttaggcatattagatatttatactgaagctggagatactagatttattggagatactgttatttacaatgaagatttcaatgaaacttatgttggatttgaaaatcattctggtagaacttatgttaatgggttaaagccacttggaaaatgtgttcatggttatggtaataatgggtctgatggatatgaaggctgtatatataagaatacttattgtacatacttccatggatcattacttgcaaaaaatcctgaactggcagatagatttattaaaacagctttagaaatgaaatactcagaagttgctttagaaagactagatgactctttagaaataaaagctaaagaagtaatgattaacaggttaaataacaaacaaaaataataatatttacttataagaaggacggggagattatatgtcaaagaaattttttagagcttttgttctaacactatgcttatcattagtagtacctttctttaatactattaatgtatttgctgcaactgaacctcaaataattggggaatctgctattactatggatttagatacaggcgaaattatttattcaaaaaatgctgatgaacaacgttcacctgcaagtacaactaaattattaacatcactactatttgctgaaagcaaaagtaaagatgatttaattccttacactgaaaactcagtttcactaagagagacaactttaaataactttattggtaatactgcaaaacctggtgataccctaactgctaatgaagtaatgaatgctgttatggtttattcagcaaatgatgctgctgttatgatggctgaatcagtttctggttctgtagagaagtttacagaattaatgaaccaaacagctaaagaacttggtgcagtaaacactaatttcgttaatcctaatggtttagaaatagacgctaatagtcataatgttactacagcttacgatttagctttaattgctaaagctgcttatgcaaataattgggtacgagaagctatgggaatagacaaaacttctgttattttagacggcaaaacaatttatatcgaaactagagataaaatacttggcgttgatggtaatattggtggtaaaactggtaatgaaactaaggctggacattgttttgtaggatactataacagaaatggaagaaatttaattactgtagttctaggttctctatatggagctgatggaatgaacgtatttaatgatactcaatcaattgctgattatagttatgatgcacaaaaaactacttataaatctgctggagatgaagtatctactgttgaattaagctataaattatttagattctttggtccaacaaaaactattacagctccagttgttttagatgagaatattgagtattatcaaaatagctttaatgatactcattctaatttagaagtaccaatagacgaattaaatgcttggaaagttgcttcaaataacaatgttgatttaacttatactagtggtgcttatactcaaactgttaaggggtctatcacactaagtactgggcaactattaaaagctaatataggaatatacgttctttctttattaataattattttaataattgtattactaattgttacaataaaattaatgatgaactctaagagacgtagaagaaatagaagaggaagatactcaagatactaaaatagtaataagttaatatcaaaattccttaaaagtttctattagtttattgaaaaccccctgtttaaaaaacagaggggttttttattattagttgtgcaaaaaattaagcttcaaaatataatcaaaattattaatctattttaaattatgttatatatttgtataaaattaaaaactactgacactttctcaacaccctgaaaggtattaataaataaaaaattcattaagacctttttacaaaaacaattcaaaatttaaatagaattaatatgaatactgtctattatataaatcataatagaatcctttcttttcgggagagtatgtagatttgtgtaaaacacaaacctatatactctcactgtctttttaatatctactatagtttttataaaaaactataatcattaattactataaatctattccaactaatattgaattaatattttcctcagcattttttatagctttttttcgttcttcttcgcttgtacctgttccatctaccttaagttcttgaacatgtttaattccaatatacttcattattttagctacgtaattttctccattatccattatagaatctaatatccaaggtatatttccccctgaagactctatatatactaatgctctattcttatcatttaataatccctttggcttttttccttcttcaaaagaaattgttttatctgcttgaactatacaatcaatatattcctttaagggtgctggaaatgataaactccacattggagctgctattacatacatttgtgcacttataaattgatcacataactctcttattcttcttatttctttctgatccttttcaggtaatttcttcgcatcttcttcactaattacgcaatttctatctttaaaatattgatattctaatcttggtatatgttccttatataaatctatttcttctacctcaaaatcactatacttttctaaaaaactattaataaaagttcttgctacagttttggacgctgacaattcttctggttttgaattaacacttatatataataattttttcttcatatatacacctcttttctttaatattatttactttttatataaatttaataactaaaaaatcctgcagtaaaattactgtaggattttttcagctgtacttctcctctttcgtttatcattctaaaaaactctatgcaataaattaatatatttttagttatattaaatattagtataaaattaaagactgttaacaaagtgtcagcagtctaataaaaaaaatttctattttcaattcaatataagcttatttattcattaatttgaaatttgttacttttaagttatcactatttaaatattgcagttacccattcattagtttgatgtttactaataagcttaaatccataactttcaacattactcttaacttcatcaaaactccactctacaagtccagaaactaataaatttccatcttcttttaaatgagcttttatgtattccataaacatcttagtttcttctccaccgatatttatgaatatccaatcaaaactttctttaaccaagtcagtatcatctaatatattccctactacagcttctatattagttaaattatttaatgaagcattaagcattacctcatcttcaacatctcttatatccactgctacaagcttttctgcccctgctatagctgcagcaattgaaagtatacctgatcctgttccaatatctaaaacagttttattttttaattctagctcatttaaaatcagctttaatatatcttgagtagtttcatgaagtcctgttccgaaagcaccttgagatatgaagttaatctttgttttcccttcaaactcttcttctggagcagctataacatacttatcatctaaatgaatagctggaaaatcaaatgtagtataatcattgttgttttcttctacatttatataatccatttttaatatatcttttaacttttctttaaactcttctaagccttcttgctcttcataagcaacctttaaaattatttcttcatcttctctttctatatatccatatccataatcatcagtagtaatttctaatggattttcatagaaaacattatatatgtcatttattgctagttcttctatagttgaatctaatttttcatatggaagtctatatgatattataaacatttttcatcctcatttctttatttaactttactatttaatttctttgtattttttgttacactaaaattcctttttcctttattcttagtattcttgttatttttcacagattttttcttaaaactctttttagatgtatctctttgcttgccttctttttcttcgatattgtctacttttgctttaacttcttttttccctaaactttcttttttatgtatcggcttttttgctactgaatatccgaattttcctaaggcttctgtatccattttgaaatactctccatgacaatatgtaattaaatcagcttcttcaagatgaattttacctttttcatccattaaatctttatccacatgtgatcctactacctctgcaataaataaatcatgtgttccaaggggagttatactttttactttacattcaatagatatagggcattcatttatatatggaacatcaacatttgttccctctaccatcgtaaaattcatttcttttattttatcaaacttacgtcccggtctaacaccacagtaatcaacagctcttgtcatatcactacttggaagattaactgtaaactccattgtttcttttatatattcataagatagtctttctggtctcacagatattgataacatagggggtttagtacatactgttcctgtccatgctacagtaaaaacattttctttatcctctttatttttagatgttatcaaaacaactggtactgggtttaaaataacactacctttaaactctaccttttctttcatatcatttcacacctttttcaaaaattatctaaacgattataacacagtttggataaattgcgaagcaatttatatttaactaagagtttatagttaagaattaatagtagtaggaaaccccaaaggaactttcttaataatatactttttcaaattcagcttaactaaatttattccttaactattaactaaaaaagaagccttacggcttccttttactcataaataaatttatatacgttatatctcgtacttactttatcaacatattttttagtttccttaaaaggaatatatgttaagttttcaccatcactagagtattcaggatcattaagccatttagttacattcccactcccaccattatatgcagctaacactaggcttaagtcatcaaattctaccagaagattatttaaataccaacatccaaattcaatattggtctctggttcgaataacatctcaggctcaaaattatcaatttcaagttttccggctatccattctcctgtagaatccattatttgcattaatccctttgctcccttaatagattccgcattttcattaaagttactttcagttttaataaccgctaatactaaatatggatctaagttatatttggtactatactcatttattatatcactatatttatatggataaatatattcttttacaaaatatctcgctccagttaataatacaaataaaacaatcaaccaaataataatttttttaaatttcattccctctccctactttgaaatagattaaatagaccttaaaaattcaattagtaaatcaacttgttctttagtttttgataatgtatcattattttcaataactatattagcaaaatctttttttctatctaaaggcatttgagaattaattctattaattgcatcttctctcattaatgaatctcttgatcttactctttgaatttgtgtattattatctacccaaactaagataacataatccatatctttatgcaaatcattctctattaaagtaggtgcatctaaaattacaatacttctctttttcttttctaattcatcaagtttatcattaatttcattctttatatatggaagaattatttcttcatatttttttctttgctttggaaatctaaaaatatgattaccaaactcttttctacgaaactctcctctccaatcaaagaaacctgcaccaaattcaactttaaccttttctaaaatctccggatattttactaatacttctttagcaacaatatcagcatcaactatttcaaaaccagcttcctttaacataaatgaaactgtacttttacctgaccctattcctccagtcaatcctatctttatcatctctaccccctattttgcatcataccatgtatttcctatattcgtatctacttctaacattactgacatctttagtacattttccatttcttcttttactaatactttaacagtttctaactcattttctttaacatttaaaataagttcatcgtgtacttgaagaatcatttgacttgctaaattttccttctttattctgttataaaccttaaccatagcaagtttaataatatcagcagcactcccttgaattggagcattcattgctaatctttctccaagagcttttactattttatttgatgattttatttctggaataaatcttcttctatttaatactgttaaaacataacctttttctttagcttcttcctgaacactttctaaatacccttttatttttggatatctatcaaagtaaatttccatatattcagcagcttcttttctagttatttttaaatcttgagacagactaaaatcaccaattccataaactataccaaaattaactgctttagctctacttctcataagagatgtaacttcttctactggtactttaaatacttcagaagcagttttagtgtgaatatcactatgatgattaaatgcatctatcatatttttatcatctgacatatgagcaagaactctaagttcaatttgagaatagtcacaagataataatacatcagtagattcctgtggtataaatacttttcttatttctcttcccatttcatacttaacaggtatattttgaagatttggctctgtacttgataatcttcctgttgttgtaacagtttgattaaaacttgaatgaatagcaccatcttcgtctataacattctttaatccttctacataagtagagtttagtttagttatttgcctataataaataatcttttctatcactggatgcttatccattaatttttctaatacatctgcattagttgaatatccagttttagtttttttaattactggtaagtctaacttttcaaaaagaatcttacctaattgctttggtgaacttatattaaactcttcttcacaaagctcatatatttctttttcggttctagatatttcctctttaaacttaactgcaagttcatcaagtttttctctattcacattaaaccctatagcttccatgcttgataaaattgatattaaaggatgttccacttcataataaagctcatccattccttctttatctatcctatcctttaaatattcgtaaagctctttcatactcgccatagcattacaaattaattcatcaccttcaccttttacttctttcattaaatattcatttattaatacttctaaaggatagtttgatttagctgaatctataagataagctgcaactactgtatcaaatataaatttctttacttcaacattgtactttgttaatattgtgattaaatttttaccatcttgaattactttttctactttctcatcttccataaaagctttaagtacattaattgcttcattagaattttccatatttattaatttgaaatctattaaactaactttatcaccatagtttatatatagtttatctaattctattttagaataaatatttgagttacaagtactataagaaataaaagctattccctcttttactgataatacttctttaagttcttctattgtagttacttcatttatttctatttttgctacttcttcttcaacttctaaatcatctcctggaagttttgctaataaagacttcattccaagcttaaagaataattttttaagttcttctcttttataattttcttgacttttaatatcttctaaatcaaaatctattggaacttctgtcataatagtagctaactttttactgaaaatcgcttgttcactataagtttctaaattttctttaagttttttaccactaatttcatctatatgtgaaagtacgccttccattgatccataagtagaaataagcttaaatgctgtcttttctcctacccctggtactcctggaatgttatctgacttatctcccataagacctttaacatcaatatattgagttggggtaactccaaactcctcaataaatgcatctttattataaacagcagtctctgttactccctttttagtaataacaactttaatattatcacttgcaagttgtagagcatctctgtctcctgtaactataaatacttcaatcccattcttttctgcaaattgagctaatgtaccgattatatcatctgcttcaaaaccatctatctcatatatattaacagctaataaattaagtacttcttttacaagagggaattgttctcccaattctggaggcatcttttttctaccagctttataatcttcatattctttatgtctaaatgttggtgcctttctatcaaaagccgcaactatgtaatcaggtttaatttcttccttcattttaaataacatatttgtaaagccatagacagcatttgtatgaattccttcactatttgttaaaggtggtattgcataaaatgctctatttaataaactgtttgaatctaaaatcagcaatctttccattctttcctccagtattttacttttatatttttaactattatttagtaattataacatatttatattaaaatatactaagttctaattcttctgataaatcttttaatatatgtattccaccaatactgtttcccttagaatctaacgctggtccatatatacctattccaaatcttctaggaactgcagctattattcctccacctactcctgattttgctggaacgccaacatgaactgcaaattctcctgaagcatcatacattccacaagtaaccataatagtctttactattctacatatctctcttgaaattaaaacttcatcattccaaggtgcaataccatcatttgcaattacagctgaaaatcttgctaaatcctttgcagtagcttctattgaacattgcttaaaataaagatctaatatatcttcaacatttccttctaaaatattagaacttttcataaagtaagccaaagatctatttctatctccagtagctttttcactttcataaatttccttgtttattgagatattaggattatttgtagctcttcttaagaaatttaatattctttgaattttatgctcttcattttctccaaatataagtgaagttgttactattgctcctgcgttaatcataggattatatggtctatcttgatttctaatttcaagattcactatactattaaatcccattcctgttggctcaacgtttacttttttaaatacattttctcttccattgtcattaagtgcaattattaaactaacaacctttgaaatactttgtattgtaaatttaacatcactttgtccagcccaatattcctcattattttttatatcatatacacaaaggcctaaatcttccttcttagattttaataatgctggtatataagaagctacttttccttcttctgtgtattttttatttttttctactaagttaattaataaatttttcatttttttatccttttcatttaagtaaaattctttattttatttgaataataaacctagctgacactttaaattttaaacttatattaaaaattgtacagcatcaattcactaatcaaaaaagttagcaaatttattttatttttgcagtaataattatattaatattattaacttcttacaagttattatataatttaaatttataaaaatgaagtattagagatttattctgtaacctcatctttaccatttccacactaatattgatcaatatttccaaagaaatatatttcccttctaacctatcactttttcttcttttcttgattcagcttaatgcataatcctctatgcttttgttcgtcttataaataactcttaataatactgtaaataataaataatatcttctttaatttaaatattaaaatacttttattttcttttaaaaaatttactagctaagcatgtcataatataaaattacatataactacactatttattaattttacttattttatttataacatatatgctttttaaaagataaaatactatactttccgtaatgatgttatactatatttataaattataattccacattttaaggaggaccatatatgaataatgatttattaagaaaatacgcttctctagctgttaatacaggtgttaatattcaaaaagataatatattagttatttcatcaccaattgaaactgcagaatttgcaagattaattacagaagaagcatataaagccggtgctaaagatgttatagtacattacggagatcaaaagctaactaaaataaaattagaaaatagttcgctagaaaccatctctaatgttccagaatggcaagcagaaagttataattactatgctagacaaggagcttgctttatttcaatagctgcaagtgatcctgatggattaaaaggtattcctgttgaaaaaataggtgcttctcaaaaggctagaacttcagcactaaaagaatactatgataattcaatgtctaataaatgtcgttggtgtgtactatcagttccaacactatcatgggctaaaaaagtattccctaatgtaagcgatgataacgcaatggagtcattatgggatgttatatttaaaacagtaagagttgatactgaaaatccagtaaaggcttgggaaaaacataatgcttacttagaagaaaaaattaaatttatgaatgataacaactttaaaatcgtacacttaaaatcttcaaatggaactgatttaaatattgaacttccagagggtcatatttgggctggtggctctgaaggagatgctaatggaataccatttaatgcaaatatgcctactgaagaagtatttacccttccaaagaaaacaggagtaaatggtatagtttattcatctaagcctttaagttatggtggaaatttaatagataatttctcaattactttcaaagatggtaaggctgttgatttcactgctgaaactggatatgatgttctaaaacaaatgcttgatagtgatgatggagctaaatacttaggtgaggttgcttttgttccttatgattcacctatttctaattcaaagttgattttcttcaatacgttatttgatgaaaatgccgcttgtcatttggcctttggaagagcttatgaatcttgtataaaagatgctgataagtattccgaagaagaacttgaaagaataggtgttaataattctgttatccatgttgattttatgattggaactaaagatcttgaaatcactggaattaataaaaatggtgaaactattcaaatctttactaacggtaattgggcttattaaagttattatttgacatataaaaagagtgtttataattataaacactctttttatattattcatttattatgtatattgttaatctttaaagttttattattaaattttagtgatgactattgacctattttttgagcactatctggtctaggttgattcttacctaattttcttgattcattagaataacctacctcatttgctgtttctactctcatcttttgtaattcagcctttgttttttgtccagatttcttattatcttttgagtttttattatttttatgagacatttatttattacctcctttgctttcaagcttattttatgtttcctataataaattatgcctcatattcaactccaatatatggtttagactacgttgctaatacaagtattagtgacaacgtagtctatactttttatttataatctacttcttatttccttaatgaattcatatgtgtttacagtttttatttcttttaaatctgtaagcatagctaaatccttagtcattactccatcttctattgtttgtaatgaagccctttctaacctgtctgcaaaagaaactaactctaagttattgtctaattctcctctttttcttaaagctccagtccaagcaaaaatagtagccatcgaattagtagaagtttcttcaccttttaagtgcttataataatgtctttgaactgttccatgagctgcttcatattcgtagtatccatctggtgatactaaaactgaagtcatcattgcaagtgatccaaaagcagttgctaccatatcactcattacatccccatcataattcttacatgcccaaataaaaccaccattagatttaataactcttgcaactgcatcatctattaacgtataaaaatactctatattagcctcttcaaacttatttttatattcattttcaaaaatttcattaaatatatccttaaatgtatgatcgtatttctttgaaatagtatcctttgatgcaaaccataaatcttgtttagtatctaatgcaaaattaaaacaacttcttgcaaagcttgcaatagatttattagtattatgcatccccattactacgcctggaccttcaaagttatgaatagtttccctaacttctttgccatcttcgctagtaaaaactagttctgccttcccttttccctcaaacttcatttcaacattcttataaatgtctccatacgcatgtcttgctattgtaattgatttttcccaattctttacgtgcggtttaattgagctaactgtaattggagctctaaataccgtcccgtctaaaatagctctaattgttccattagggcttttccacatttcttttaaattgtactcttttattctatctgcatttggagttattgttgcacatttaactcctacgccatacttttttatagcttctgcagcttctactgtaaccctatcatttgtttcatttcttttttctatccccaaatcataatattctgtttttagttcaacaaaaggatttaataattcctcctttatcataccccaaataacccttgtcatctcatctccatccatttcaaccaacggagttgtcatttttattttttccataatatatagcccccttatttttgtattttttacattaataacaatattatatcacaccttttcttcttttcaacctttaatgatggatttaatataattacttgcaattttcaataattttttagcacttatatcaattaaaatagtattttttgaattatatatattaattcttgcattttaattgtataaaaaaaagactaccctaaaataaaatggaccctatatagtagacactcaaaaaaagagtatctatctatatagagttttaattcattatttttccatatgaataaaaagtgagtattatcgaaaaaatttcgataatactcacttttactttaaaatcaatagtaatctatttttttaatataacactaaaatagcgacagccccttcttttcattttatagaaaattatatttgtaaagaatctggggacaacttttaaaattatcagaaatacatagttttcaaatcagaggtaagatattagtttatgattattaaaatattgatataaatgtataatgtttaagtccatatgaaaatattttaatttcaatatagcgaataattgtaatataaactatattttggtactatataattggtaaatttaaagttttcaaagcaataaatatacaataatgctaacattaaacttaaatattaaagaatggggttggtgtaatgttgaaaaatgattttaagattgctgtaataggattagggtatgttggaatgcctttagcaattgcattttcaaaaaaagtggatgttattggctttgatgtcaataaggaaaagataaataaatacattaatggtatagatgtaactaatgaggttggaaatgactcattaagggaatctaaagtagaatttacatatgatgaagaaaaattaaaagaagcaaaatttcatatagttgctgtacctactccaataaatggagataaaactcctgacttaaggcttgtaattggtgcaagtgaaatagttgggagaaatttaaaaaggggttcaatagttgtatttgaatcaacagtatatccaggggtaacggaagagatttgtgcacctatattagagcgtgaatcaggattaaaatgtggagaagactttaagataggatattctccagaaagaataaatccaggtgataaggttaatacattagaaaaaatagttaaaatagtttcgggaatggatgaagaaagcttagatataatagctaagacttatgaaatgattattgaagctggagtatatagggctgaaagtattaaggttgctgaagctgcaaaagttatagaaaattcacaaagagatgttaatattgcttttgtaaatgagttatcaatgatatttaataaaatgggcataaatactaagtctgttttagatgcagcagcaactaagtggaactttattaggtttaatccaggtcttgttggaggacactgcataggggtagatccatattatttaacttataagggagagcagttagggtatagttctcaaataatagcttctggaagaagaataaatgatgggatgggaaaatttattgctgatgaaactataaagcaaatgattaaatcaaataaaagaataaatggagctagaattggaatattaggaataacttttaaggaaaactgcactgatgttagaaatacaaaagtaatagatataattaatgaattaagggagtattcaactaattgtatagttgttgattatatggcaaataaggaagaagtaagtgaaaagtacaatatagaactagttgattttaatgaattaaaatatttagattgtttaatcttagctgttgcacatgatgattataaaagattagatttaaagaagattaaggaattatattctgatgaaaacaaagtattaattgatattaaatctttaataaataaagtagaggcagaagagcaaggatttgtttattggagtttataaaataagtagtatttagggggacagccatgaggcataataaactaaagatactaggaatagtagctataattattatagtatcaatagtaggttttaaaatttttgaaaatagaaatataaataaagctgagaaaaaagattatataatatatgatgctgataaagctattaaaaaagcattagagaaattagctaatactgataaaaaggccaatataataggtgatgttagtacatccaaaaaagttatggcacttaattttgttggattatctacaccagaaacaaatgataaagttttagatatattaaataagtataaaacaaaaagtacattttttattccaggaatattagctgcagaaaataatgatatatttgaaaggctaaagaatgaagaccataaggttggaagcaatggattgttaggtgaaaataaaatggagtcatatactagtgaagatttagttgattcctttattcgttctaataagataatacaaaagtggattaataaaaatgagtctattttattatattgtaattcaactaactatacagatgatgtattaaaggcggcttatgttagtggaaatgaaacagttgttaaaagtaagtatatattaaattatagaagttttaattcatatgagcaaacattagcttatataagtaaaattccaaagggagctatgattacagttaaattagatggagagttagatgatactgaatatattcaggatgaaaagccagcagaagatatgcagggaactattgtagaaaatccattaaatgaacttgatgaagaagaaagacttattatggttgttgaatggattgtaaaagcaataaatgaattaaattataatgtggtaagttgtgatgaactttcaaagtatggtgaacttgataatagtgagaatattatcattaataatactgttaatgaatcttattattataataacaaaaaaaatcaatcaacttctaacaatggacaaacatcttctaatgatgattttgattatgtaactccaataagcttagatgaatattacataaataaagctaatgaacttagagttgaaaataatggaaaaaaggcagtggaagatggagatatatatactatacaaccggctgttgggtatagtttttatggaataagtaatactactgttttacaagatgttttaaataaattaaatgcacaaaatataaaagctacgttctttgtaagtgaaaatgatataaataaaaatgaaaatcaaataaaagaaatagttaataatggacatgaacttcaaattatgttagttgaaagtacaggtaaagattatttatctgtcgcaaagagcattttaaagattaaaagttatataaagagtaaatttaatcaagatgcaagtctagttaggtatccatatgaagttaagtattctgatgaagcattagaggcaataagcgcaactagctgtaaagttattggtgataatttatctgtagcaacatcacgtgttggaaaagatggaactattgatgatgttataaataatatatttcatttaggaaaccaatcattacataagggatatatagtttactttagaatggattattataatgataatactataattgggaaccttgtagaaataataaaatctgacaaagttgatactattggctatatagataatggtgttaagaataatggatatggatttgaaacattaggtaaattagctacaagtgaatatatatttaattatccacttactgattctgaaatactaccagatgtattaaataggattaaaaaaggaacattggaaaatgttgaagaccctataggatacatttctaaaaggtatataggtagcccttatgctaaagatacagagtcattaccaggatttacaaaggaagaaattgagcttttagattatagtggtaggtttactgatgataagactattttcttaagctttgatgactggggttcagatgtgtcaattaataaattactttatgttttagataagtatgatgtaaaagcaacattttttgttcgtaccaattatattaatgataatccaagcttattacgtacaattgcattagctggtcatgatatagcaagtcattcaaataatcatcttttgttaagtaatactactgaaaatcaaggggtatttacagaacttagtgatgaagaagcaaaggttctacaagatgatgtaatactttcttatgacagactacaaaggattataggtgatatttatattgatggaaggcctgcattacaagcatattttagaccaccaacactggcagtaagtaaaaaaggattaatgagtgtatttgattctggatttaattatgtaatttcaggagattttacaacacaggactatgaggctaaaagtgctgaacaattaattgataaattaaaaaatggtattgtaactggagaagatgaggcaattaaaattaaaccaggaactgttttagttatgcatatgtctgatcaagcacagtttacagcagaagcattagatacgataataccatattatttatcacaaggttataagtttggaagaattagtgattatttaaagtaaaactttataactttggagggaggtagcatgtttaaaagtatcaaatcgaggatggataaagagcaaagtgatattttacttaaattaagtagtgatagaagattattatctcatgtcccagatcctaaaaaaactcgttcaggtaaggagagaagaggtagtgttttaggtgagtgtgataaagaggataaggttagatatagtgtagaatataaagttactgtaataagttattcaaataatcttaaaaaaactacttttaaatgtaagggagttaatgtttcaactacaggtatgctcctaaaaattagcgataaaaaatatcgtgatatacttgaaaaatctagcaagataattttaaagtttaagataattccagggactatgccagaaggctatgagatgaaggttaaaatcaagtctagttatataagaacagcagttaatggtgatgatatttatattggagttaagtttgataagagtcttagagagattaaggatagatataaaggaaagtatacaattcttatatcaagtttattattagcttttgttactttgtttattatctttatgagaattgaaagtgtactttattttaagtttaatagatggatgtatttatatagtattataactgcttcgtttttattaagtagatatatttggggagccatgtatagacctataaaggttgatcctgaatatactccaggagtaactattttaattccttgttttaatgaagaacagtggattcaacaaactattcttagttgtattaatcaagattatccaattgataagttacaagtaatagtaattgatgattgttcaaatgacaagtcagtggaaaaaataaaggaaatagtagaaaaattaataaatgaagatgaaagatataaggttaaggaacgattaacatatattgttcaagagcaaaatgctgggaagagagaggcattagctgttggagcaaaggaagctaaccatgaacttttagtttttgttgattctgatagtttcttagctcctgatgcaattagaaatttagttcaaccttttaaggatcctaaaatgggcggagttgcaggaagaacagatgttgcaaatacttatactaatgtattaacaaagatgcaatcagttagatattatattgcctttcgtattatgaaggcagcagaagctcgttttgatgctgtaacatgtttatcaggtccattagcatgctatagaagagatatagttatagaaaaaactgatgagtggttaaatcaaagctttttaggtcaaaaagcaacatttggtgatgatagagctatgacaaactttgttttaatgaagcatagaacaggctatcaagatactgctgtttgttcaactgttgttcctaataaatataaggtgtttttaaagcaacaaatgagatggaagaggtcttggcttagagaatctttaattgcaggaaggtttatgtggagaaaagaaccctttgcagcagtaactttttatatgggattattagtaccaattttagctccaataatagttgtttataatttaataattgtaccattttcatataatattttccctacaacttttattattggacttttaatgatggcaatgcttatgagtataactcagttaagattaagaaaaagcacaacttggttatttggattagtattttgcttattctatgaggctatattattatggcaaatgcctgttgcatgggtgacgttctggaagtctacatggggcacaagaatgacgccaagtgatatagaagagaaaagaagaaaagaagaagcaaagagcagaaaatgtaaaggaagaactaagaaaaatactattaatgatgattcttatatgggggaatctatataagtacaaactataaattttatataaatggtgaataatatgaattataaatttaactcaaaaaaggattatataaaggtaataagaggtacaattgaaggagttattttactaggacttttagttttagttataaaaaccttattttccacaacaagttatgtagagtatgatgttactacagaaaagaaggatgaaaatggatttgtagctttatcttattttggaacaaacaggacaggctcaaatactgttatatctactgagcatttagaggaacatttaaaaaccttatatgaaaatggatatgttacaattactcagcaagatataattgattattataagcatggaaaagatctgcctaacaaggcattgtttttaatgtttgaagatggatatagaggaacagctatatttgcacaaaaaataatggaaaaatataattttaaggcaactattcttacttatccagagaagtttgataataaggatcctaagttcttagtaccaaaggacttattagagttagaagaaagtacatattgggaacttggaaccaatggatatagactttcttatattaatgtttttgataaaaatgatgaatatgttggagaattaaactctttagaatatactgaaatgatggataagctagcgcgtaactataatcattatcttatggattatataagagatgaaaaggggatacctaaggaaacttatactcaaatgaagacacgtataacgactgattatgaattattaaaggaaagatatttagatgggataggatatgtacctaaattacatgttttaatgcatgcaaacacaggaatgtttggaaataataataatgttagtaaagttaacgaaaaaaatattagggagttatttgatataaattataatcgtgaaggttattcttataataatgaagaaaataatatatatgacttaactagaatgcaaccacagccatattggtatcctaatcatttattaatgagaattaaggatgatactaatgaagatattaagtttgagtatggtgatgaagatagaggaaagtattgggaggatcttaagggagcaacagaatatagaggcgatgttatagcattaacatcactttcaaaggattctgggttaattaagcttaaagatagtgaaaattataagaatgttaatttaaatactatattaacagggaatatgattggatcacaagctgtatatttaagagctgatgaggatatgcaaaattatattaaggttcagataattaataatattttatatgtatatcaatgtgttaatggtagtgaagttactttatatgaaaaagaattaccaataagtgatgaatatgcagataaggatattcaaataaatactccagcaactagaaatctacaaattaagttaaatggtaatactgtagaagttgtagtagatgaagtaattgtcaattgtaatacagaagttattgattctggatatatttatttagagtcagcatggggtgattatggatatagtcagcgtaatcttgttgatgatgtttatgatggggtatttgaaaagctatatgtaattgactctgatactgatgaaatattatatgataatagatataaagggtttgaaaagattgcaaatgttgcaaaaaatatttggcttaatatcgtaaattggtttattgaaacattgtaaaagtagttattaaaatactaaggtaggattttatatgaagaaattaacaaggttattgcttagtggaatttgccttttatcggtattgtatttcattggatgtaatagtgctgaaaataaagcagaagtagatagtgaattaaaagggactacagaaataaatggtgaattagaaggtgttactgaaaaagttaatgtatggttagcttattgggataccttagattttgaggaagaaatagaatattggaaggatagaatttctaatataatttattttgcagcatattttgatgagaataataaactgtttgttccagataatattactgaaactaaagaagttattgatgagttatatgaagaaaagtcttggggaaattacattagttttgtaaatgacaaggtttattctaatgggaagtcaacattaaaggatactgaattattatatgagctttttgaaagtgaagaatctatagataatcatgtaaatgaaattataaatatagctattgaaggcggatatgatggaatagaaatagattatgaaaaaataagaaaagacttaaagctgtgggataagttcatttatttcttagaaaagttaataaaggaagctgaggaatataatttgcctataagggtattattagaaccatctactccagttgatgaaattagtttaccaaagggacctgaatatataatgatgtgttataacttatatggctatggaacagagccaggacctaaggccaatagagaatttttacttgagcttgttgataagatgaaaaaagtttctgataataggggatatgctttagctacaggtggttttgactttgctaataatggagaagttaatgcaataacaaagcaagaagctgaaaggttattagaaaacaatagtggagtagctgtaattagggatgaagatagtaagtgcaatgtgtttgaatatactgatgaaagtaatgtaaatcatgaagtatggtatgctgatgatgttactttaaagtattgggaagatatattaagtgagttaggggaaggtaatatttctatttggaaattaggagaaacaagatagagccttaataaaatggaagccagtaaatacattaatgatgtgtttattgattaggcatgaataataaatgtcaagttaagcaattaagtggattacttattagattatattaatattattttttattatatataaatagagagagtagatatgtttggataattacaagcatgtctactctctttatttataaaataaaatattagattttagtatattgattatttatatagaagaaaaatctaatattttatctctataataattaaatatactttcttttataatattaaacattaaaaagtgtaaatgaaactgtaaatgtaaaatcatcataattgataaataattctccatcatatttttggatagcggtatttatattttttaatcccataccatgagaattgatgtctttttttgatgttttaaagtttttattaataattacatttttatcaatagagttaattattttacaaatcaatatattgccttttgacattaatttaatttctaaatacttgttgttttttactttagataaagcctcaatagcattgtctaatatattactaaatattatacagcaatcaagtaaatcaatttttaagtttttgtttataaatatatctgttgaaagttttatattttgcctttttgctatttctaatttttctgttaagatagaatctaatacaggattaccagtatcaattaatatttttttatcagtagaaaatttaccaataatatttgatatgtaatttttagaaacttcaatattattattatcaattaagttatagactgtgctccaatgatttaacatatcatgtttataggaagcaatatttgaatttttttcttttatataattatagtattttaattgataatctaattgtaactttaaaaaatcattgtcttcttttattttttttagatttgaaatattttttaatatacttataaaaatatataattcagttaataaagttcctaatgataaaaaactgatattaaatatatcggatttaaaatcataaagtattgaatctaaattgaaagaaataaatagtattattaaaatgtttattaatatttttaaaagactattttttttagattctaatatgattatagttatacaaatagaaattgtaataaaaaatattaatataaaaatccattgtaataagtaaaatgatgataatcctataaattgaagtagcataaatattaataatatgtatatatgaattttatatattataaaaatgaattttttgttatttaagttatattctaaaaatatgtatttatataaaaatacaggaaaagagaataaactaataaactgtaggaaataaattaatgaatagttattaaatataaagacaaagaattgtgattctgaaaatatccaaattgctatggataaaaaaatcaatgacaaataatatccattaaaattaattccataaacttttttataaaatatagaagcaagtaataagataaaagctaaaataaaagttaaaaacgataatatagctttaggaagagtttcgaaaaatagctctgataaaattaatggtttgcttctaagcataactctagataagttaccagataatttattatatgatgatataaattcaattttaagagtttttccaaaacaatctttgggcaatttaactaatagccatacagccccaccagttttaccattattaatctttctcatagagtcaaagttgtatataagaacatcatccaagtaaactctaatttcttgttgagaagatcccactcttaaatatggatctattataaaatcattagggatttgtttttcaatgctaataatattttcagcagtattttcttttgtataataaggtagatttatttttttcttgatattagttcctgatatagttaataaccaatctttagaaaagttgtttgtgatggaacaagtataacctttattagtatatctaatagaaatagctataaaaaacaatcctagcaacaaaattaataagtaaattatatgtttaaatttaattttcaaagttattactcctatgtaaattagctatctataaagctatttaataaaaatttgctatattttgattttagcgattttatatatttttcgccaattggaagaatagtatcatcattacaaattatgtttttaccaattattgattttatgtaattggtatttattaaaaatgatctatgtatttgtacaaaattatcatcatttatttggttaattaattttttcattgtgaagtaaaaattaatactagttccatctatacatttcatagtaactattctatttcttatttcaaaaaatagaattttatttttatctatacattcaatagtatgccctatcttgtagtgaaaaagattatcttttctaggttttattaagcttattgctctcataaaaacttcttcaaatttttttgtgtctaaattttgctttattaaataatgtaatggcatagtatctaatgcttcaaagacatgatctttacttgaagttaaaaatataatttgagatgttaaattatattttctaattgtatttgctaaatctataccagtcagatcatctattaatacatccaaaaaatatatatcaatagaattaatttcattatccatgttaaatataagattttgggaagaagaatatttaataatatttacatctaaattgtttttggaagaaatttcatttatcttatcacttagctttaataaaaattcagtattatcatcacatatacagatattaaacatttctatacctcctataaatatcaatatttattaaaaattataatataattttatggaaaaatatagtttaatacaaaaaaaaagccttttacaacaagttataagtctttttttggggaaataaatataattaaagaagttgagaattagctatattttatatattgaaacaaaaaggggggaaataggtatgtttaaggttataaaaaatagaaatgatataaattttattacaatagaaaattatttatttgaaatttatgataaaagaataaatatttatgaattaaaaactgatgaatttgtggaaagtatgtcaattgaagatgaaagggattatataaatttaattgtaatttgtgagaattggattatagaaaaaagatgtaataaatagaaattaatttataagtacatatttaagaataaagttaaatttaaggaaaagcaaatctaaggaaagggtagtagattaataataagtaatgtagtgaaatacttagtttttaatattaatctatgaattatggagagtatatgatttatttagagcatgatgatttggaggtaattaaaaaaattttaggtaagttatatttagaaaatggacttactgaagaagtaattttattaagcagagttgtagataaagctatattaaatagttatgttgaattacagtttgatgataatgttgatagaaataaagataatttgaataaataataaaatcttaattattattgttttattaaaaaaatattttaaattgattttataaattaggataattataagaaagcaaaatagataaagacttgaaattatagttgcaataacaatatttttagtgtagattaaataaattttatatttacaacatataaaacagtgtttacaacatataaacagtatttacaactaaaaataatttttctatatataaataataaaatcactaatgtttgattaagtaaagtattaatttattaagtatgtattttaaaaaaaacataaataaatttattatagaaaattgaagtaaatctcttagaataattatgtaacattataaagctttataaattagtattttctagttataagcttaataaataaaattacaaagaatggaggggttaaatttctttagaatcattctttgcataactagtatattataaagaaaggaaggtatgttataagttatgaggagaaaaataaggaaaggtctagtatttataataggaatgttaatgattttaagtacattaactaatgagttaagtgtatatgtacaggctactattaataattctcaagtattggttgaaggtgaggaaaatgatacttcagttataaatgtaaataatgaagaagctttacttaaagaatcaggtattactgtatataatgataaaaataataatggttggtattatatcattgaaaatggggtgaaaaagactgtttactgttatcaacatgataaaacacaaccatctatatatggaactagtggttattcaaagattaactttttttcatccaatgtagctacaccagcaagtccagcaacaaaggaaatgattgcaactttattgtatttgggctttccatcaaatgcaacagaacttcaagaaaaatggagagttgatgattcacgagcaaattatcttactcaacagaccgtatgggatttagcaaggggagatgtaataacttatcttaaggatcaggcatatgattatgatttacactattattcaggaagtccagatagtccttattacggaaaatatggatatagtggaaacataaatttatcaggtgatacaatttttcaaaggattggagatacatataagacaggtgtaattaatattgaaggggattatacaggaagtttttcttttgactctttaccgtcaggaattaaaatttataatgcatctacaagtcaagaagtaacaggagcattaactgttgggatgcagatttattttacttatgatggaactacgacattagggagccagattgatcttaagtataagtatgatactacagaagttttttatttgaaagcaagtaactcatctaatcaagatttggttggattagatgttaaaaataatgagggagtgcttacattaacagctaaagaggataaaaaagtatcatatactgtagttaaaaaatggaacgattcaagtaataaagataatttaagacctaatagtatagaagtacaattaaaagcagatgataaagcttacggtaatgtagttgttttaaatgaaaacaataattggacatatacatggcaaggtattccggaaaaatcttctcaaggtacaattaagtattcagtagaagaaatagggaatttagctaattataatgttacatacgaagagaaaaatcaaactaccgtaattacaaatacagaaactatggatattcctgtaactaaaaaatgggtaggagatgcagcacaaagtgctactattagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctgtaactaaaaaatgggtaggagatgcagcacaaagtgctactattagattatttgccgatggagttgaagtagattcaattgaattaacaaaggataacaactggaaacacacttttactggactagctaagtataatcaaacaactggacttgaaataaattatttaataaaagaagatgctgtaaatggatatgatactgttattacaggaaatgccgagtctgggttcacagttataaatacaattacaggaaaaacttctgtaggagtaacaaaagagtggattggaccagcagcaaaaaatgtaacagtcaacttattagcagatggaaaaaaagttgatactcaagtattaaatgaaaaaaataattggcaatatactttcactaatttagaaaagtataaagacggaaaagaaatttcatatactgttgaagaagtttcacttcaaggttacagttcagtaattagtggagatagtcaaaatggtttcgttataacaaatacaaacactgaaactatggacattcctgtaactaaaaaatgggtaggagatgcagcacaaagtgctactattagattatttgccgatggagttgaagtagattcaattgatttaacaaaagataataattggaaacacacttttactggactagctaagtataatcaaacaactggacttgaaataaattactcaataaaagaagatgctgtaaatggatatgatactgttattacaggaaatgataaatcaggatttacagttactaatacaagaataacaggaaagttagaaataataaaaacagatatagcagatggaaagctattgcctaatgccggatttaaaatttatgatgaggacaagaacgtaatagcagaaggaagaacagatgaaaaagggattgcaacatttgagttaggatacggaaagtattactatcaagaatttgatgcaccagaaggatacgtaatagacgaaacactattcccatttgaaattaaaacaaatgaagaaatagtaaaagttgaaatgacaaatacaaaaatagtaggaaagttagaaataacaaaaacagatatagcagatggaaagctattgcctaatgccggatttaaaatttatgatgaggacaagaacgtaatagcagaaggaagaacagatgagaaagggattgcaacatttgagttaggatacggaaagtattactatcaagaatttgatgcaccagaaggatatgtaatagacgaaacactattcccatttgaaattaaaacaaatggagaaattgttaagtcaactatgacaaacactaaaaaacgaatagaaatacctaaagaagatcaaaaaactccaacagataataataatatcaataataataataataacactttaccgaaaactggagatatatccagtgttgtatatttattattatcactatttattattttagctgggaaaatactaattagtagaaaagaaacttattaataatagtatatagtttattggtaagaattaaaaaaggggagagtagatagagtttgtacaatataagcatagatgaaaatcactttagtgatagacatctatgcttattttttttatgataggtttgattggtcaacgaagatagatttgggataaaacgcccgttacacaaagtgttgaccaacacatcctattcaatattcgattaagcaagttgggagaaacacccgtgtaaataacaaatatgaatcaataggatgatgttggaaccaatcgtaaataacatatggagatgattaataatgataggagttggaattgatatttctaaaaataaaagtacagtgtctgcaataaatgatactggagaaatcattatgaaaccacaagaatttaaacatagtcagaatgaacttaataagcttattcagtggattaaggatcaagaagatacagtgttcgtagttatggaatctacaggtcattatcattatccagtattgaagaagttatatgaagaagggatatatgttagtgtagttaatgcttatctaatgaaaaaatatggggatatagagattagaaaagctaaaacagataaaaaagatgctattagaatagctaaatacgctattgaaaaaagatttagtcttaagaaatatgaaggtgaagatgaaaaatataatgatttaaagtttttatcgagacaatataatcaaatagtttcaatacgagtaaaggcaaagatacaatttaacaatcttcttgatgaaattatgcctggaatcaataaaattttaactagaacaacaggaaattcaagcaagatattatatgattttgttgaaaagtatgaacactttgataatatcaaacgtaagggtgaacaaaagtttataaaagagtattcagcttggtcaaaaaagaaaggataccgtaatggaacaattaaagcactaaaaatatatgaattggcccaaaacagtatcacaactagatctgctaataattctacatatattgctcttaaaaattgtattaaaattttaagagaaactgaagaatctagcaattctattttaacacagatgcaaacaattgcgtacacattaccggaatataaaattgttagggaattaaaaggtgttggtgataagcttgcaccaagactaattgctgagattggagatgttagaaaatttacaagtgctaaagcattgaatgcttatgccggaaatgatgcacctccacatcaatcaggtcaatttgaaggaactaaaagacatatatcaaaacgtggttcttctagcttaagaaaagtcggatacgaaataatgatggctttaaaagttacaaaaccaactgaagataatgctgtttatgaatttatgataaaaaaagaatccgagggaaaagcaaaaaacgtggctaaaatggctgctcttaataagttcttaagaatttattatacacgcgttatgaatttatataaaacattgtaatagctagtccacttaataaagctactatgaagtagctttattaaggttacacttttttaggtatattaaattaaaaataatagttgacaaattattagcaagtttgtgtaaaatacaaatctatctactttttatattattacttatactaatgacagtttgaagtatttttatttggagtaatatatttagtacaaaattttaactgtttacaacgaataattactttctagaatgaaattgatatataatccattttatgatattagttacaaataggaggtttataagtatggaagttttattagttatgttattgatatttgcttttggagcaattatattttcaataataacatatgtttttatggggttatccttatcaggggcagcagagcttgagggaatagataaaaagtggtttgcttggataccaatattaaatatgtttatattattaaaagtagggaataaagatgttagatatacttgggtttttgttggagtaatgctagcaagttttttaacggagttcaatgataatggttttttaattcttataaatttagcattaattatatggtctattgttatacaaatacagtcatacttagttatatctaataaatatcaagtaaagccagcctggtttattgttgggatattcataacacctatattgctagtagcgtatatacttctttataataaagtgaaaaggtgtaaagaagttagagcaagtttaaaataaaaagttataatattaatagtaagtaaggttctttaaatattaagtacatagtaaaaaaagatgagtcctatattgtgaattatcccttatcaagtagatagagggtataaaactatttaggagtcatctttttttgttactagattatttattatatttaatatacttcgtacctatttcggccagcctttttggctctataaagtgccatatcagctttatttattaaagaatatatattttgacctaagaatttagtattatatatacccatacttattgttaataaattacttactttagagtatttatgctctatattcttatttttaatattattttgtattttttgagcaatggcttcagtatcattaggagataaatcagtgaaaattaataccatttcttctccaccatatctaattataatatcattttttctgatactattttttaatgtagttgcaacttcctttattattttatctccttcaatatgtccataattatcgttatactttttaaagtaatcaatatcaataataataatagaaattgtttttgttagtaagttctttttgtttttatttatataataatctaaatactttctattatttaaacctgtcatagaatcagtaaagtttgagctttttaaaatttttacagatctatgtttacttaatgctattatagttaatataattaaactaaaaagcataatcaataaatttaacttgtatccttgggattttgattttaataaattactttcatatagattagctgaataatcaatatggtcttttttaaaaatctgaacactattatctttttctttaatatataaatcagtatatttagcataattattaaaatcttctttagccttatatatttcactaatttgataataaatattttcttctaatcctaatcccttattaatagattcttgtaatacgttttcgtataatggtaatgcttgctcgtataatttttgttctttataccattgagcataagctaaattaatgaatacatctttatttagtgaaaattcaacttcatcattagctaataaattttgggcttctatgagctgtgtttctgcgtcttcaaagttatgttgatatgtattagctaaggcaagtatattattcataagtatttgaatatcatctttagcataatcgtcaatataaggtaataggtcatttaattcactaacacactgactagccatttcatattgttttaactcgatataagcctgacccttgttaattatagtaaggcttttacttaatgcatcttcatttttatctgctaagttaatatttaaggattgatcataataatttattgcattttcatattcacttaaaatgaagttaatatctccaatacttgttaataacttagctttataataatctccattagggatagaaggatttgaagaaataatatggatagcatctaagtaattatacatggcatctgaatatttatatactaatgtatataattgacctatattagctgttaatttaactatactttcattggttaatcctttagtatcatttaaataagagtttaaaagcaaaatgccttcttgtatttggtctgtattatctagtaatacactgattgtacgccatattaaatttgtatcatttttgtaatcatttttttcagagatatattttaaagcaattttacaattttctattaaagaatcatattgattttctatttgtagtgattcatttaataggatataagtataaatttttataaagggtaagtctgaatatataatattttctgaagctaaattaaaattttcaatagctttaacataatcattatttatgtaatttaaatatccttttataaaataatactcactatcaggttttttctctaataaatattgctcaattttttcaatatcatttgtaatggtagtttgattttgaattgaatcttcaatatatgtaattatgctttcagtattaagagtattattttcttcagataatttattattgaattttactataggaaataaaataatcacaatagaagcaagtattatgctacttattataattggttttttatattcattttccaaattaatgctcccttcaaattactaagaatataaaattaagaatattttgtaaaaacaaaattaaataaaatagcatataagcttatttttatacaaatttatatactatatagaaatttttattagctatacttttaattgattcttgtattttagtgataataaatattacttattatattttgaagttctttcatttaataatatataagttaaatttaagaaaatttattttaatagtataattataaaaagtataaaaaaatatgtcaattttttttgtttgtgtatttatcttaaaaatttaataaatatttaatacaaaaataatctctttatagcatttattttctattattaatgaatatataatacaatgaatttaaataaaaggggagtaatgatttacattaatagtataaaggaactttaagattatgggtaaagtaaattattatagtattgataatggaatgcttgaaaaatattatgatattaattaggttatagaaagtttttatgattatgatgaagttataaataaaagggtaactttaattaaaatattaactttatggttagcaatattcgatatattattatatgaaagaatttgtaataaagggctaattgaaagagtaaaagaagatgatgatggattaataaaaggtcaagcttttaagcttgaccttttatataagggaatttacagtgaatggtatttatagaaatttcaaatagaaattatatgaaaattccttttcattaaatctatattcttgtggtaattcagggccgcagctatttgagccaataccactttgtttataatcaataattaaataagttaaattttctttatttaactcaaaattatggtcagtattagttaacttattaacagaaaaatgtgaaacattaaaggcaaaatcattttcagatacaacatagattgtcttcttactattactaatagaaacttctctacagaaatgatggcttccattttcctgaggttttatataatcttcatgcatttcagaaacagtagaattaaatctgcctaaataacatgatgaattcttatctatataattttcatatggaccaaagccaaagtaacttacgtgttcatatgatttatttaattttaattgtactccaaaacgtggtaagtaaggtgttttcatatttttattagccttaacatcacatttaattaaaccatgtgggtaaatgatccaagttactgtaagatcaagaaccttttctctatatggaggaattaagcataaggaactaattatttcaactttatttgaatatgtcttaatttcattattatatacatgtgttgtaatttgatcaaaaccagcttcaatccaatcattttttatttttctatcattatctgtaggcgccctccaaataatgaaatccataggagtatctataaatacttctcctaatgattcgataaactcaaaggaagcggtatttttattatatataaaattaaaatctgaatttgtaattttaattttgttaattgttgcttctatataaaacttttcagaggtatcattaatttttgttagtttagttatagatgatatgttttcagcaccattttttataataaattgatcatggcctaaaattgtatttttttcataaagtgaattattatattttacactgtattcaaatagtatagtaattattccctttggtaaatttgatatatttaagtcataccatttttcttcttttgcttttaggctttctaatattaatttattagatgaaagtaagcagccgtctaaatacactttataagtaatatctaagaagtcattaatatttttaaaatcaagcatgttttttagtttaacttttttattagtttgatctaattctaatgcccttataggtctgttaacatttttaaattccaataatccagtatgaggagttctgtcaggataaactaaaccatcaacacagaagtttccatcatgatttacttcttcaaaatctccaccatatccatatgcttttttaccattgttatattcttttataagtagagcatggtcacaccattcccaaacataagcacctgcaaattcatcatgattttgaataagctcatcatactcatttagtccaccaggaccattccccattgcatgtgcatattcacataatattaatggcttgtctataccttttttaaagtaatcttcaatttcatctatgcttggatacattctactaataacatcaaggttagaaaaatcattttttctctctttattagcgtaaaatgcaccttcataatgtaatggacgtgaagaatctaattttctagcatgtttagctccactttcgaagttgattccaaagcctgattcatttccaagtgaccacataaaaatgcaagatctatttttaaaaggaactatggaagagtcaattctatctataataacattttcataagttatatcatcggctatcatattataattatctaaatagcctgttccatacaattcaacaaccccatgagtttcaatatcagcttcactcataacataaaatccatattcatcgcataattcataaaagattggagatttaggataatgagatgttcttatagaattaatgttacattctttcattaattttaaatcacaaagcaagtcatcataagtaataacatatcctttaactggatcagaatcatggtgattaacacctttcaattttataggagtatcattaatttttaaaattgaattttctattttaatttctctcatccctattttttcttttataacttcattttctgtttctattaataatgtgtataaattaggggattcagcatcccaaagttctacatcaataatatctatttgtaagttattatcatttatgtctccagaagaaattatagtattatttggatttaataaagtatatttaatatgtggattaccaatagttgaaagaattttaagatctaattttccatttttagatgatacgtttacagtaggagtaatcttataatcaacaattcttgattttgatcttgttagtatatacacatctctaaaaatacccgacattctaaatttgtcttggtcttcaaaataagtaccatcacaccattttaaaactaatactgtaatagtatttttaccattaactaagaagtttgtaatatcaaattcagatatgctatgagatatttgactatagccaacaaacatatcatttacccaaaaataaaaacatgaatctactccttcaaagtttatatgataatcttgtgattcagaatttattttaaaatcaaattcctttttataaattgcacatggattatccttaggcacaaaaggtggattataaggaataggatatttaacatttgtatattgattataatcatatccattcatttgccaaacagatggcacatcaattgaatctgaaagattaatttcgctaatattattaaagtttttaattaattgtaggctatcgaaataattaaattgccattttccattaagtgaaaaaaagctagtttgcttatttctatctttaacattaatagcttcatcattatcaataaatggaacatagtaacttcttctttgcatcatgttaacatgcagtttataaagattttcgtgatattcatttaatagtggcatggttccctcctaatatatttaatttaatttaattatgtataatgaaacataattatatataagtatcttttttaagtatttctttcttgtaatttaatattaatatgcagattaatattttgaaatagttataaggttctaaaatatggtataatgtttccattataattttgtggttaataataggggccttattaaacttttataaataagattgagagaagacttaatataaaatcaattggttttataggtttggaggtatatatgcaaatactatggaaaaaatatactaaagaaaattttgaaatgaatgtagatgagtgtggaatagagcaaggtattccaggctttggctataaatatgaagtgttaaaaaatgcagttatacattatataactaaggggcatggtacatttaaaataaatgacaagttatacaacttaggacaaggtgatgtatttatattattgaagggaatgaaagttgaatatatggcatcaatagatgatccgtgggaatattactggataggttttagtggttcaaatgctaatgagtatttaaataggacatctataattgattcttatgctgctaagtgtaaagaagattcaaaaattccagatataatatcaaatatgtgtgaaatatcaaaagcttataatccttcaggttctgatgatatattattattaaaggaactttattcagtattatatgcatttatagaggagtttccaaaggtttttgagtataaggataaagagttacatacatatattcaagaagcaattgattttattaattctaattatatgaatagtataactgttaatgatattgctgagcatgtaaatttaagtagaagttatttatataaaatgtttataaaaaatcttaaggtttctccacagaaatatcttataaatcttagaatgtataaagcaacgttattattaaaaaacactaggattcctattggggaagttgcaagtaaggttggatatagtgattcgttattattttcaaaaacattttcaaaatgtttttcaatgtctccattaaattatagaaataatcaaattagtgctaatagatagttataaatgatttgatgattactttaaatctttagaggtttatcagtagtttagaaaataaaaaatataaatataagaaggagtatttatattgaattgattaattcaacctaaatactccttttaataataatgctagaaaaagtaaaacagttgtatctatttatttggtaaatggatttcaaatagtcagtataaaaatttattttaatatattcctttaattttatttagtcacttattcttgtaactccatgttttaaatcatcaactattgcatcatattctgcttgtgataaattatattttcttaataataagaagcttgttaatataattatacatggaactaaggtttgaattatgtgtattccatttaatgtgaaggtagattgagtagaatttgcttcatagccaatataggctaaaatgtatccacataaagatcctccaactgcattggaaattttacttttaaatatatttagagaaaatatcataccttctgatctttttcctgttttccactcaccatattcaacacaatcagcaaccattgaagttaagcttatatatccagctccgtcaaaaattccagatatgaaatttatagctatcattgcatatagtgaagaatatgatagtaaaaatagtacaaataatccaccagcagaaactaataatcctaaaagtgcagtatttctttttccaagtttttttgctaaatatggagatattaatcctcctaatatacttgcaactaaagaaattgaagttacaacaggaatcatcatttctgaattaaagttatatttaatataatatatagatattgtattttttattgatccgcttaactctagtactaacattgataataatactattcttaaaggtttatttgactttaataaatttacaaattgtttaaagccttgcttttcttttttagtagaagtgctactaatttctctaattccaaaagcagtaatccaagtaagtactgttgcaaaacaaacataaattattgcaactgttgtccagcttttaagagctgaaacaagtggaatagtaagtgtagaaattataaatccaccaacgtatgcaactgttcttgctgatgtaacaatcttagtttttccctcagaagatcttgtaatatttgcagatagtgaccaatatggtatgtccatagcagtaaaagatattccccagaatatatatgctacatatatccagataattttattgctataagttaagtttggtgatgaaaagcacattattgttgcaattcccataaggataggaactataaataaataaggtctacttttacctattttagtatttgtattatcaactataacacccattataggatctgttattccatctataattcttgctactaaaaataatgtacctacagcagctgcacctactccaaaattatcagttaaaaaaattaaaagatatgaatttattaatgaaaagattagattatttcctaagcttcctgagctataagtaagtaaggtctttatagaaacattatcatttttatcaatttttttatctatttctttatctatttttttatttattgttgtattcacactctcacccctatatttcttagtaatatccttatacctgtttaattaaacatttaatagaaatcgatttctcagtttacatatatattattacaaaatttttagtttaataatatagcattaagtttctaaaatattgatttatatttcctaattagattattattttagaaggtttgagggagaatagtattgaatatatataaagaagagtttcaatttagatttaatggttgaaaattatcatgaagatagatgtgatatattaatatgtaaccatggatatttgggagaattcttcattaatagtatctcttactcttgaggttgatatgttatatgataaaaagactgaggagtttattgaagttaataatataaatttattaatttatgatgaattataggaagaatgtttaaatggtaataaattacaaagtgtaataaatgcgtagatatgataatctatgcatttttgtttataaatagatatttgggttatataatatatgtagagaaataaacatggagatgtgaattatgagtaatgataagaagcaaagagagctttatgatatgagagctaattctttaagagataaaataagtgaattaaatgcagcagaaaagaaaggaagagaagaaggaagagaagaaggaagagaagaaggtgcaaaaaataaagctatagaaatagctagaaatatgaaattaaatggactagatactgaaactatttcaaaaattacaggtttatcattacttgaaatagaagaattatagaaagtatgtttaatgatcaataaagtaacaaatataaatactattcagatgtagaatgtaagcatttttatttaaaaagaagtatataaaataccgataacagttccaatttatcgactataacagtctgtaaattggaacttatttttttattaccaattatatattgacataacaatacaggtgtatatacaattgaaactgagaaatgttacacaattggatataaattcaataaaaattacagatacaggagtgataatagtgagaaataaaattgcaggagctatatatggaatggcactaggggatgccatgggaatgccttcagaattatggggaagagaaaaagtaagaaaatattttggaaagattgaaggcttgttagatgggcctaaagaaaatagtgtagcttgcaattataaaagaggacaatttacagatgatactggacaagcgtttgttttagtagagtcattaaatagtacaaactttaaacctaattctaaagatattgcagaaaggcttttaaaatgggcagaaaaagaaaaagcatttgaaaataatattttaggtcctacttcaaaggttgcattagctaactttagagatggaatagattcaaaagcagttacggataaggctttatcaaatggatcagctatgagaattgcaccgataggatgtctttttaatgctaatgataaagaaagattagctaactttgtttatggagtttcagaagtaactcatactagtgatatatcaattgcaggggcagctatgatagcagtagctgttagttcagctattgaaaatagtgactttgaagctgttataaaagatgtctttgaaatagagcctattgctagaaagttaggtgcagaaacatttagtccatcattaactgaaagaataaaattaggtatttatttagctaataaatataaggatgatgaagatttatttttagaaaaactatatgacatagttggagctggtgtaaatattagcgagtctgttccatctgcaatttctatagcttattatgcacaagaccctaataagtgtgcggtgctttgtgcaaatttagctggagatactgatactattggagcaatggcaactgcaatttgtggagcttttaagggaatagattctataaagaaagagtatattgaagccttaaacgaagcaaatgatgttgattttaatagatatatttctatcttaatggaaggaaggagttgcatttagtgaagactttagtacttggagctgccatagtagatattattatgaaaatacctaagctacctaaaagtggtgaggatgttttatgtactgaaagaaaagtaactgtaggtggatgtgcttataatgttgcaaatatcttgagaggatttaatgtggaacatgatttatttgtaccaataggatctggaatgtatgcagatataataagaaaaacattaagtgaagatgggtatgatgttttaataagtgatttagaaatggacaatggatattgtttatgtttagtagaagatgatggtgaaagaacatttattactgttaagggtattgaagggcttcataaaaaggaatggtttaatagcttaaatatgagtgaatatgaaaatatatatgtagctggctatcagctttgtgaagataaggatgacataatagcaaattggttaatagggcaaaagaacaagaatatattttttgcaccaggtccagttattaatgatatagataaaaatacaatgaaaaagatattttcaactaacccaatattacatcttaatgaaaaggaagctttggattttactaaaaaggataatgtgaataagagcattttatctttatataaattaactaaaaatactgtattcataacagttggtgaaagaggaacagtactttatgatgggcaagaaattgttcatataaatggtgaaactgtgaatgttgtagatacaataggggctggtgatagtcatattggtgcaattatttcagcatattctttaggggtatctaaggaggtttctttagtggattcaaataagctttattccaaggattcaaggaagcttcattccaaggattcaatgggtatttctttaaatgactcacaggtagattgtttagaaaataatgttggatatgattttgtgtctggatgcaaattagcaaataaggtagctgcagaagtagtgcaaataaaaggggccaagcttagtaaagaatgctttgataaatttaatatttgatataggtaagttaaatttattagatattattattagttttaaattataagtaagagtaatttttttagatgctaaaagtataaaaaatagcagtgcaaataagataagtaagatttgaaatacagatagcaatgattgtaattaagcgtaaaggtataaagagggggaatattattatggataaaattaaaaattatttcgcagattggacaatgtttgaaaaattatggctaataacagtatgtacaattatgacgattatttggtacttaaatggggatgcaccatttttattggcactaactttaactggtagccttaatttagttttaggtgcaaaaggaaagatagcaggattatattttgcaattattaattgtttattatattcatatcaatgtatgggagtaaagctttatggagaagtaatgtataatatgttatttagtattcctgttagtgctatagccatatatttatggaataaaaataaggatgatgatgggaaaatacgctttaaggttatgtctggtaagttaatagtattaacttttgctggtacattagtctgtgtattcttatatgctagggtattaaatttattaggtgggaatttagcatttatggattctttaacaactgtagtttctgttgtggctagtattctttatttaatgagattttctgagcaatggttaatgtgggttggggtaaatgctttatcaatagtaatgtggataatggtatatgcatctggtgataagagtgcacttattataatagttatgaagcttactaatttattgaattctttatatggttattataattggaagaagatcgcaggacaaactaatttaaaagtaaaaaacttcacagaggcaagctaatatagttatatcagtagtattaggagctttagcttctattgctggaggatttatgtctaagaagaaataaggttacatttagggtataatgttttcaaagtacaagaaatgcgtagatttaataatctacgcattttttatagttaatacaaataacattattgatagaatttaatatagaataatatgatataattattttatataaagtatgtgcgagtaagcttgaggtgattatagatgaaaaagcttatgctcaaagactgtcaaatagattatattaacttgaaaaatattatagcgatatgtgttttttgaagttatcacgaggaagtattcaataaagatagaagtgatatagatataatgattctttctaagaatcaattggaatttgatgatgagatggagattgaagattatctccaaaaagtattatcagaatatttttctcatgataatattcattttacctttattaatgagtttaattacccttttagtgaaatattcttaataaataatgataaaataatttttaaagaagaagaatatttagattatgttttaggatattcagcatttaagagagatagggaagctttagaagttatcagagaggaaaatctaaaggatttgtgtttatataggaatggtttattatcaatataaaaaagaaaagatagaagcaaaatttttggaaagtaaaatatttttagttaaaataagagaatgtataactcgtaatgtagatggtgatgatgatataattaatgaagctatgatttcatattttaattctttttgtgaatttataatagatatgtgtgaaacttatttggtatcaacagataattatatacctaacaaatcaggtagtgaaataatagaaacagcaagtaattttggatttatttcttctaaagattctaaaaagctacaatctataataaggctaagaaatagatatactcatgattactatcaacgtaaactttcaagagaaaagataattaaaatgtgtagaggagatttatctacattagatttatttttagaagtatcacaagaaaaaattagattagtaataaatagttagtgatggcgctgaattagtaatagattaagaagtgtaaacaatgcgtagatgctgttatctacgcattgtttatttaaggttttctttcatatggtatataagtattatgtaaaaattacaaaagaaattctgaaaataacttgaagtaagtaatatagtagtataattttaaatggtataccaaaaaaagtttatcaagggtgatgaaagtggatataaggattgaagagatagaaaaagataagctaagggtaaaatctatggttgaggttcatggtggtagtatttctgtaaatagtatattaaatcaaggtagtgtttttgaagttaaattaccccatgtattagtagataatgcaccaatgaatgtatataaatttaatgaaaataatacagaactagaattgtcagatatatatagttaatgttactaccatgaaggactaataatttttaaggagaattgttattagtaattagagtctttattaattagatatttatctatatttaagcaaggatcttctgatttagtagcagcttcaattttatatctaagaaataaaaagagtatagaaggtagtgctgataaagcaaatataaaataaactaaaattgatattttttctttgggatttaaataaagtgacatatatattgtaaagaatatcataaacagcataaataatgtccaaagccaacttataaattttaaagttattaaaataaaattcttcataaaatacatctcctttacttaccaaataaattcatcataaaaaattatataacaaaaaaagggaatttgctatatttaacaattaataaaattagatatattacctataaatattataaaattttactatatagtataataatgataattatagtattattataattattttataaaaaatagttaaaatatattgcaaatgttgaaataggtcgcaaatatagttaacataagcaattattaaaatgatataataatatatgtttttaaagagaaaataatatattaaaaaagggaaaatagtgatggaaaagagaataagaaaagcaataataccagcagcaggtctgggaactagatttttacctgcaacaaaggctcaaccgaaggaaatgcttccaatagttgataagccaacattacaatacattatagaagaatgtgttgcatcaggaatagaagaaattcttataataacaggaagaaacaaaaaatctatagaagatcattttgatagaagtgttgaattagaaatggagcttgaaaaagcaggaaaacaagaaatgcttgaaatggttagagaaatatcagatatggtaaatatccatttcataagacaaaagcaaccaagaggattaggacatgctatactttgtgcaaagactttcgtaggagatgagccatttgcagtacttcttggagatgacgtagtttataatgataataagccatgcttaaagcaacttgttgattgttatgcagaatacaaaacttcagttttaggagttcaaacagtagctcctcaagatgtaaacaaatatggaatagttggtggaatacacattgaagacagagtatacaaagtaaaagacttagtagaaaagccagctatagaagaagcaccttctaatgtggctatcttaggtagatatataattacaccaaagatatttgaaatattagaaaatactaaaccaggtaagggaaatgaaattcaacttactgatgcattgcttgaacttattaaacatgaagcaatgtatgcatatgattttgaaggaagaagatatgatgttggggacaaattaggattccttcaagcaactgtagaatatgcacttagaaaagaagaattaagagatgggtttatagaatatttaaaaactataatataactttttttacttcctcagaggaattattttcctctggggaaatttaattatggggtgaagatatgaaggacacaaatatagaaaaattaatactgaattatgtagaaagtaatataacagaagaagtaaaagaagattttattaatgcagtagttcatttcattattaatgaagaaaactttaacaaatacgatagtatgagaattaaatatagatttaaaaagataaaatctaacgatgttcttgattacatcaaattatgctcaatttatggatatattatttatagatcagtagtgtttggattagttgaagatagtgaaaaatctaaatgttgtgaagttattatagaactaagtaatgaaataactaagtacttaactatggaaagtgatgaatcagacttacataagaatatggagctagcaatttcaaaattatatataagtgatgaatgtaataacattgttttagataagtttaaagattgtaaatttgatttcgtacaataatataaataagtattaatatattattagttatgtgaggagtaatagtaatgaaaaagaataagggtaaaaagattgcattatggattttagcaattgttttagttatagttttaggtgcagttggtggagcgtttatttatgcaaattctttatttaataagatggaaaaggttgaaatagataaagataatgttggaattacagaagaggtccaagaaaaattatctgaatatgatgacaaggtaacaaacatagctttatttggtatagatgctggagaagatggtattggaagatcggattctataatgatagcaactatagatacacataataagaagttaaagttaacatcaataatgagagattcttatgtaagtattgatggtcatggattagataagataaatcatgcttatgcctttggtaaatcacaattagctattaaaaccttaaatgaaaattttgatttaaacatagaggattttgttgcagttaacttttcatcattacctaaaataatagataaaataggtggaatagaattagacatagattcagaagaattaaaatatattaatggatatataagtgatataaattcagttaatggaacaaattctccagcaatatcaactactggacttcaacatgtagatggtacgcaagctatgggatactgtagaataagatatacttctggtggggattataagagaactgaaagacatagggaagttttaactaagatatttgaaaagatattatctatgtcaccaacatcttacccatcattattaagtgatttattaccaatggttagcacaagtcttgatgcaagtgaaataatggatttaggtaataaattattaagtataggaaattcaagcttagaacaagaaaggttcccgagagatgggtactgtgaagggcaaatgataaatggagtatattatttaacatttgataaagaaacaactgtaaatcagttacatgattatatttttgaagataagaaaacttgggaataataaatagtgcctccgttgccaattcaatatttggattgacaacggaggcaaaaacatatatttctatcataagggaataaatagatatattagtatggggatattatttagttttataattaatattatttagttttataattaatattatttagttttataattaatattatttcacaagcagcaattgattttgtagttttataattaatattatttatataatatgattctatctaaattgatatgtatagcaataagtaagagaattgcttattattagtctagatagatgaaatattttaacttttatagtttatgaataaataaaatggtaagaatagtggttatataacttaataggtttattttaattaaggggggacaggtatgaagaaaaaattaagtatagtattgtgtatattatggatgggatttatattttataattccagtcaaccaggaaatcaatctaatgaaaaaagtactaaggtacttaatatgataaaagaatttaaagatgatacacttgatatgattagaaaaataatgaatggtaataatagttcaagcttaaatggatatatagtttataatgaaagtacaaggaaaatagttaatcctaatagtactattaattggggaaagtgtaatgaagaagagataagtaatatatttattacatatgataatagtgaaagttatgatagtattgagctttgtgggattaattcagaaaaggtggcttataataaaatagcttcaaatgggataaaaattaataaagtaagcctagaatcaaatgatattttaaaaaatagaagaattagtattaataaaagtgatattaagaatttgcttattaaagtaagtgataagataaaagcatttgtatatgagcattttaataattttaatgtttttgttagaaaatgtgctcatgcctttgagttttcagttcttgctatacttttattatgggcaatgtcatgtcatggcattaagggaatgaaatctgttatttttgcattattaatagttttcttttatgcaatgacagatgaatttcatcagttatttgtaccaggaagaggagctaatattaatgatgttatgattgattttattggtggaataataggaagtgttttatatacttgcattagctggctttgtaattttaaagtaagtgcttttgaaagagtgtaattaaaaagttcatagttataaataggactgaatattagtgctttatacagttcaatttaagaaccaggtaagaattaatgagtttgagtagaattgaatattagttctttatgcaggaaggtgagtttactatgatgctatctttagaagataagaaattgaatattagtgctttatacaggaaggcttttttatctacatgaaagtataattaaaaagatgtaatagtgattgagttaaataataaaagatacctaattggaggctgctgaaaatatgtgatttttcagtatatatccaagtggtatcttttattttagtgtaaatattaatttttatattacacaaagaatgttaattttatttagatgatatttcattttttatatgtaaatccatttgtgggtatggaatactaatatcttcattatcaaaggcaacttttacagattcaagtaagtcaaaatgtaccttccaataatcactattattaacccaagctcttactacaaaattaatagcactatcgccatgattagaaagagcaataaatggttctggtgtttttaaaattaagtcatgagcttctactatattagataaaactcttttaaccttcaatatgtcttgttcatatcctacaccaaaagttaagtcaactcttcttaattctttagcagagtagtttactatacttccattagctaaagttccgtttgggacaagtattaatttattatcaacacttactatatgtgtgtaaaacatacctattttttcaatagtaccattgtgcccagccccttcaacataatcaccaacattgaaaggtcttattaataaaattactaaaccaccagcaaagttagataaacttccttgaagagcaagtccaattgcaaccccagctgaagcaaatactgctgctattccagtagttttaattcctacatattctaagaatacataaagaactataccttttaatattacttctataaaggtatctaaaaaagaacaaacagttagatctatatttcttctctctaaagctttatttaatatgttaactattttcttagaaagtttccaaccaatccataatataagcaatccgatgattagccttataccatctgtagctgcccagttaaacattttttctaaaaatttttctaaattcatagttatgaagaatcctcctttttatatcataatgttttatattatatagtatttttgggcattgttccaatacaaatattgcctcttgctagaaaggttactcaattaagggtgagtagttaggtaaaaaaggaatgataaaggacaaactttaatcttaagctaattacaataactagtcatgagtagataaattaatttatgcacttttgtgttataaaaaagttttaaaaattaagttttttgtaaaaatgtttatatcccgtatatgtattaagtgtaaccacaaaaaatcaaataaaagggaggaatttattatggcaaataaagctcttgaaagtacggtattatcaattgaggttgaaactgcaattgataaggatggaaatccaacattctcaaaaaagaaaataggaaatttagttgcaaatgcagaagcaggcaaaattcaatcagtagctgatttagtagcaggaatacttgaaaaaaatactggttattactatgtaactgaagtatctcaaattgaaagtaattaataagggaaaggatgtgtaaattatggagtatacattaactatgacttttataactgaatctggagaaaaggctaattttataatttctgatgtaaaggaaaatataagtgaagcagaagttaaagctcttatggatgaaattatagcaaatgctattttttctaataagaaaggttcttatgtaactaagtcagctgcttcagtaacacaaaaacaagtaactaaatttactatttagtaataaaatttataaataccagttattagatctttaagaactaatagctggtatttttgttgtgtgatagttatatcactataagtaaagcaataaaggttaataaaaggaagaagttgatttatcatattttaagattcaccatcaattagagtaatttttatggataatggatagatattggaggctagtgctccagatgaagtatttattaatgctaaaagtgatagatgtattgagtttttagataaagtaattgctcattaattaataattaatggaccctgagggtgtagtaggaagctacatcttcagggtttatttttgttaaaaaattaatataattgaataaagtcgataaatgtaatatcatatagatgtaaattgtattttaaaaatagaaaaaaatagaaaaaaatagaaaaatagaaagtagaatagtgaagtagtaggagaagaagatgaagaaaatttataaaaatagtattttttgcgttactattatcttagaaataatttatttaatatggcgtgtattttttacaattcctctatctaatggattattccctgctatatttggaattatattagtatactctgaaatagtaactgctctaggaacttttgatttaatgtataaatcatttacctataaagatgaattagagttagttcctattgaaaaagatgaatttccacatatagatgtattaatagcaactcataatgaagatgccgacttattatataaaacaattaatgcatgcacatttatggattatccagataagagtaaagtacatatttatatttgtgatgacactaatagaagtgaaattaaagatttagcagaccattttggagtaggatatattggacttgaagataacaaacatgcaaagtcaggaaattataataatgctttaatgaatacaacatcgccacttattgcaacatttgatgctgacatgattcctcaaagatcatttttacttaaaactgttccatatttctttttaccttattataaaaaggaagatgataagtggattaaattaagtgaagaagaagcagaaaaaaacaagaagatcggatttatacaaactccacaaggtttttataatgctgacttatttcaatataacttatattcagaagaaaatattccaaatgagcaagacttcttttcaaaggagataaatatattacgtaatggttcaaactcaactgtttatacagggagtaacacggttatttctagagaggcattagaaagtattgggttgtttccagtaaacactattactgaagattatgaaacgggattacgtatacaagctaagggatataaaactttttcaactagtgaagtattagcttgtggaattacccctaatacaattaaagggatgatttctcaaagaagaagatgggcacgaggtgttattcaaagtagtagaaattgtttaattccttttaataaaggtttatcaattgcaggaaatttaagctatctttttggattttcatattggtggtcattttttagaagaatcatatttatattagccccaattatgtttgctttatttgatgtacaagttgtcaattgtagttttagggatattttattattttgggcaccagcatattttttcaatacactttcaatgagattattatctaacaaaataagaaatgaaagatggaatcaaattatagataccattttggcaccatttttagttattcctgtatttttagaaacaatttgtattagtcaaaagaaatttaaagttacagataagagtaaggtaattaagaaggattataaggctgtaatttatgcaattcctaatttaatattattagttttatcaatactagctataattaaatatactaaagggaagtattctatggcacttgtatatagtatgtttattatattttggttgagttacaatatcattaacttaatatatgctatgtacttttcattaggtagaaaaatatatagaacttcagatcgtattgtagttaaagaaaatattgtaagcatggatcctcaagttgatttaagtggaataacttgtgatttatctgatactgggctttcttttaaagtacctaattatacttattttccagtagatagagatgtaaagttagaaattgttactgatttatataaagctgagttcaaagcagagattattatttgtacaaaattagaagagtctggagaatatatttatagatgcaaaattacagatattgatgataaaaataagcgtcaatatttacaaataatacatgaccgtaatatagaatcaacaaatgaattaaatttgtggatgactactattgatggaattatattaaatgctcataagagaattgaaattaatgaaaaagaaaagagaaaaatgccaagggttaaaattaacgaagatattcttttggataataatataagagcaacattagtagattttaattataattatatacttttaaataatatatcagaggaaattaaaagacataaaatttattcttttatattaaaggacaagcatgaattaaaagtcaaattatatgaaaaatcaggaacaagttctaaaaatttatttaaaattataaaccatgaagaattaatatatgataaacaatttgttagtttaataaatgaatatgcaagaaaggagagtatataataatgattgtttttacgtgtattagatttatatttatgattttatccttatttggatattcattattttttgaagaaaaactaaaaattaataggtttatttcaccattattttctttaagcataataactttaatatcttactttagtgggttattaaaattattgcaatatagttcatatattatttttattgttggattattattatttattagaaagattttaggcttaaggaaagaggatttttataatattgaagttattaatatattaaattttatgcttttaagttgttttataataatttcaattattcttttatcttctaaacttattcattacgataacttttcacattgggcaattgttgtaaaacaaatgctaattgaaaatgcatttccaaatgcaaattcagttttaattgattttaaaaactatccattaggtacatcatcttggatttattatgtatgtaaaatagttggtagtaatgaaggagttatgttagcagctcaaggaacaattatttatgctagtatttatgccttcttttctattattaaagataggaaaagactattatttagttctttaattttaatatctataggtgtaatgaatatttttaatgttgctattcgaatggataatttattagttgattttgttttaccgttagtgtccttagcaattatagcaacaatttatttttataaaaataatataaagaaatgtgtttatactatattgccaatgatgtccatgcttttaatagtaaagaataatgcaattttcttttgggctattgcaactatttatttattatacatatttttgaaatctaaaaataagaagaaaaattttcttaaagttttaatatgcattactgttagcttacttgtatatggaagttggagttatcatgtaaaaaatgaatttaaggatgttaattttaaatttgatatatcattaaaggaaagtgaagaagatactctaggtaaaggtgctgaaggtcttgaagaacatgaagatactgaaagtcaagaagttttaaataacgaaaaaattgataaagatcaagagaatgttgttagtagtaatggagggtctaagactccagaagaaattgaaattgtattaaatgaatttaaaagtcaggtatttagcacaaaaaacaatatatcaatgggatttgtttattgtaacattgctgcattaataggttgtattattttaaaaaggattaatgataaaaagcatcattcatttaaaatattacttatttcagatattactttcattttatattacataggaatattagccatgtatatctttatgatgcctatggatgaagcagagtatttagcaggctttgatagatattcatcaagtattatgatttttttagtgggtattatgacattttcatttgttatagatattgaaaattcattttatattacgcagggaagatatcgtgatatttatgcttttaaatcattgcaaagtaaaaagatatatatgaattctacacttgcagttagcgcagttggtattatgctatttttatcagagattaacggaatgacatatttgaataaacaatattacgaaacattgccaggtaaggttgaagccattgttggaaataatttttcaatggatgataatcattatgctttatatgcaactgatactgactcacaagtttctaattattatcttggatatattgcaagatatatgttaatggatcctaatgtatatgtgtttagtagttttgatgatgaatatataagagaaaatattgagaattttgattacctagttttagttgaaagtgatgatgaagctaaagcatatatgcaaaagcacgctaatagtgagggagaagttgggttatatgagatatcggaattatttcataaataaggagaagtatatatggataatttagttttaataatacctacattggaacctaatacaacatttattaaaattgtttgtaattataaaaagcattttaataaaataattgtagttgatgatggaagtggagaggaatatagggatatattcaaagaaattagagatatgggaatagtagttttaactcatgctttaaattatggaaaaggaagagcattaaaaacggcttttaattatgtattaaataattacaaagatgtaattggagttataactgttgatagtgatggacaacacttagtaaaggatgcattaaaatgtagtcaggaacttattaattcagaaaataagctagtattaggaagccgtaattttgatgaagataatgtacctttaaaaagtagggttggaaataagttaacaaggagcttatttaaaatattatgtggtatttcaattagtgatacacaaacaggattacgtgcaattgctattaatgatattaagagatttttatatacaaaaggtgaaagatttgaatatgaaactaatatgctattagatgctaaaaagtataatattaaatttgaagaggtacctatagaaacagtatatttaaatgaaaataaaggcacacattttaatccacttcgtgattcagttgaaatttataaggtatttataaagtatttatttgtttcattaagttcatttttagtagatatattattttttatgttatttttaaatattttaagcttgtttagtgatttttcatttatcatgtacaagattatagtatctacagtgtgtgcaagaataatatcatcactttataactatttattaaatagaaaatttgtttttgaacagcatgattctaaaagttttattatcaaatattatatattggtaattattcaaatgggaatttctagcttgagtgttgcttcattatcacaaattttcagcagtaagataatagttttattaaagataatagtagatatattaatttttattgctaattattacatacaaagagaatgggtatttaatgataaaaaataataagttagattaaagtaattgttagatttaaagttagttagtgaaataaatggaatagttatatataacgttaatgtttaaattaataatgtattataatagaaacttatacaattatacagttataggaggcattattttattgattcaagtaattttattagaagaattatattgcttgaaaacaataaggaagtataacatgatgctaaaattaaattaagtacttcagataagtctttaaatggtaagtatacaactatttttaaaattattattaattaattatgtctcggaaacatactcatgtatatgagtttgcttccgagataatttattttagggattaggcagattttaagtattaaattacatataaaagcgaacaatccttataaaatctgtttagaaatatagatataagttaataatcataactggtgatgaattatgattaatttctataaaactttagttaatagtatattaaaagatgagaaaaagaataacaataaaataagtattaatggtaagacggataaaagtaataaaactaaatgtcctaaatgtaactgtgaaaaggttattaaatttggattttttaaaggagctcaaagatataaatgtaataacgaaggttgtggaaaaacatttattgaagataaagataatccttttagatgttcaaagaagtttaaggaaaattatcaagattactttaaactttttatacaaggaaagtccattagagaatgtgcttctaaaatgaatattaccataacaacatcatttttttggagacatagatttttagcagatttttgtaatgaaaactatattgaaaaaatagattcttatgttgaattaagtaaaatgattatattagaaaattttaaaggtgataaaaaatatcatggggaagaaagagataaaattgtagttgttactgcaataaatgatcgtatagatgtactaccaataattgctgggagaagattcctagatttttatgaaataagaaataatcttattccaagaatagataacaaagcatatatagtaggttttcaagatagtagattaaaaacttttgctaaagctttaaatgagatacgaaaagttaagttaaaatataattgtgattttaaaatagatttagcttattctataaaagtgaaagcatggcttaaaaaatttaatggagtagcaagcaaatatttagatcactatttaaattggagagcttttgaatataaaaataatataatacatgaagaaagaaataatttttcattgagaaaaattaactctcaacttaatataactgcagaaattaatacatacatatcatggagtaacgtaaagaaaaaagttatttctgtataaattataaaataaattaatattaatataggatttcgataatttatatgtagagaagttttatggttagattcataattttaaatttttcataagaagttcatgcagtctattttctgtttggggaatagtctatttttaatgcctagaattaaaaaactagtttatgtagatataaataaattaataaataaattaattaatttatttattagggaattagttgatgcaaagataatattatgtgtcaaagtgtatagtattatgttatatcaaaatgttgttaacaacattttgatataacatagtcctatatagaaaaagatataatagtaaaggaaagcctcaagtggattaactatagaaaatttccaagaaatattaatagtttattcctattcaattaataaataaaagactaattttttagagcaatattaaataaggttataagaagtcctaattagtattattatttaagcgcaacggattaatttaataatttatagttttaggatcaaaaaaattatagtaacaagataagcttattgttgttttttcaattaaccttttaattagatgtgaataataatatgatttagtggctagactttcaataaatagatcaaataaataatttagttagaggtgaattagatgattaattttttgataggtttaggagcaagtataggagttattattgtttattcattattaaagattgcaagcgattttgacgatgaagttgaagaaatgtataaagattatgattactatgataattgtgatttaaataaagaatataattattatgaggatacatatagaaaaaatactaataaggattagtatgaaaatcaataatcgaaagtatataaatttgtggaagttaaaattcatataagtaaatattaatttgtaataactatatttattgaattcttgttatttaagttatataaacctacagcttggtgttctagaaagtaatattttagttgaatatagaatatataattcatcactagtatattgtataattttcacaacattattagtgtttatagctatttggagtttagttatgaaaaaaattaatgttgagtttgatacaaatgcggaaaaattatgtgaagaagccagtatgatgaaagctgcagagtaataattgtattagaaggaatagaaaatcaaaaaaatattttggaacatattcacaaaatgatttgaaaagtatatatatataagtagaagcaagggtggttctatagtagaaatactagaatcaacttgctttttatttttttttacaagtataatggcgataaagttataggtgattttatggagtacaaaacacatagtctatatagtaaattttataggggtttgtaagataataaatttaagtatggattataaaaggagtaggggtaaaggtatggagagtgtaattatgaattatattgaagaaaaattaactaataacttgaagagggattttatagttgcagcaatacactttatagttgatgaagaactttgtagtcaaggggatattaaaaagatagaagatagaaagaaaggtaaaagggatgaagtagttgatgattgcttaaagctttcagccatttatggatatattgtttatagaacagttgcatcaggagcgttagatgaagaaactgagatgaagaactgtaagctgttaatggaattaagtagaactgtaagtaattatataactgcagagatagaaggggaagaattagtgtcttattttaaggagtttaccttaaaattaagaataagtaatgagtgtaataaatttgttttaagtaaaattaatgatataaaagaatatgatattcagtgggaagctgctcacgagatataaaggctaaaatataaaaaagcccgaagacataaataaataagatatccgggctttatttcatatttaaaattaactatttaccttcaaaagatgattcatcaaatttaatgaaaaagccttgtggatgagcgcatacaggacatttagcaggagctacttggccttcataaataaatccgcaatttgtacacatccaagctgttgttgcagtatttttaaataatgagccgttttcaagtctatcagcatattttttaaatctcttgctgtgaacattttctacagaagcaacattagtaaataatattgctatatcaggaaatccttcatctttagctattctagaaaattcaggataaacatttacgccttcgttattttcatcacgttctgctaatcttaataattttaaagtactagtttcaacttctacaggataagaagctgtaatttctatttcttctccagagaattcttttaatttatccataaattgtttagcatgagcaatttcttgattagcggtatataggaataagtcttgtaatatagaatagccttcttttttagcagcagaagcagcaaaggtatatctgtttcttgcttgactttcaccagcaaaagctttaagtaaattttcttttgtcttacttgaattaaaatcagtcattatgaattaccatcctttcatttcatttattttatagtctatgtaatttaccaaattttattcgatggaacaaggttcattaagattttaaaaaaatttcatgaaacaatctcgtttgctcggccaataatttccatatatatattgaaagctataagggaagagtgataaaatatgtagatagagataggggttgataaaaatgaattgttcaaagcaccatgaaagagaagcaaaaggaatgtgtgttagatgtaataggcttatttgtgaggaatgcgcagtaaaaataaataataagtattattgcaaagagtgtgtttctgaaatgtattcaacggataataaagatgaaaatactcataataataatcgaaataatattgatagcactaatgatatcaattttaataatagcagtaacgatgtgaattatactaatgagagtaatttaaataataagagtagcgatataaatgaaataaataatggtagtacaaataaagaacaattagatttagaaaaaataaattcatatacaaatgtaagtgataatttaaataacaattcaaataacaatttaaataacaaattaaatagtaattcaaatgaaaatctatatataaattatcaaacacaggagtataaagactcatcagttagaacagataggagatataaagaggtaaattatgttttagcaataatagcaattgcacttttaattcctaaagtagttttagctattggtggttttccagattgctttgagaatatgtatctttcaataaggtatgatgatggggttagagcattatttttctttataaattctttattaatattacttgagccattaataattattgcattagcagcattatcatttaagaatttcatgaaattgaaaaagataattagaattatagcaccgatagttgttgttgctgtatttacattattaatatttattacaggaaatattgcattaagatttatatatattagcccatttataagtatgttatcttatattattcctgttgctttaattgtaataggaatttgtttagagaaagagtaaattttaattattaagtagatataagattatctagtaagttaatgttaaggttaaaatcctttttttaaaagtggattttaactttaacatttcttgtttttatagaattattaataaagataaatttatagataacttataataatagttatagtaaaatttatagataacttataatatagtaaagtttatagataacttataatatagtagaatttatagttagttaagtattttttcattaaaaagtaatgtgccaaaaatatcttttattatatcttctaagtttacttaatttaaactgaaatattaatgaattgaggacatcatattttcagataattatttttaagaaaaacaatgtttttcacaaggtatttttaaagttttacttttcatttattaactataaaaaggttttattactacacttaataatgtaaaataggattaatgaattaaatttaagaaattaatttaaaagatcaatttaaaaaataaatgaaattattacttatcatatagttatataaaagatatatgttcaacataggaggtaaggatattgagtaagataaaggttttaagtgtatttggaacaagacctgaagcaataaagatgtgtccactagttaaagcgttagaaaaggatgatagaatagaatcaatagtgtgtgcaacggctcagcatagagaaatgttagatgcagttttagaaatatttgacgtaaaaccacaatatgatttaaatgtaatgtcacacggacaaacaattgtagatgtttcaaataaggttttaactggtgtagataaagtaattaaggagtgtaatccagatatagtattagttcatggagatacttcaactacattaaatggagcattagcagctttttataatcaaaagccaattggtcatgtagaagcaggtcttagaactggagatatatattcaccattcccagaagaagcaaatagaaagcttactggagcaattacaaccttacattttgctgctacaaagagtaacaaggaaaatttagaaagagaaaatatacataataatatatatattacaggtaacactgtaattgatgcacttttaagtgtaatagatgaaaatcataagtttgaagatgaaaatttaaataatatagattttgaaaataagaaattaattttattaactgctcatagaagagaaaattggggagagccaatgaaggggatttttgcagcagttagaaaaattgttactaaaaatgaagatgttaatgttatattccctatgcataaaaatccacttataagagaacttgcagctgaagggtttaaggggattgaggataaggtacatttaattgaacctttagagtatgttgattttgctaatttaatggctaagtgttatcttataatgactgattcaggaggaattcaagaggaagctcctgcacttggaaaaccagttatggttttaagaactgaaactgaaagaccagaagctattgaagctgggacagttaagttagctggtataaataaggaagatatttttaatatagcaaatgagcttattaatgataaaaaagcttatgaaaaaatggcgcatgcatctaatccatatggagatggaaaagcgtgtgagagaatagtaaatcatataattgaatattttaattaagaaaaagaccctagttaaagtagtaaaatactaaaaactagggattttttataatataattcagtaattttataatgtgttatacttgaacataaaaagaaaataatgtaaagttaaatagcaagaaaaaaattatttaagaattagaactaggggataagagtgtgcttaatttagtgaagaaggaagagggaacaaggaatagtcaaataacagtactagttatattagtaatattattgattatttgttttttaatttacttatttatgtatagtggagttggatataaatatatagtagaaagtggtattatagtatctacagaagaggggcttatagcatctacagaagatgttattgcctgcatatttttaaatatgctagcttatttagggtgtctaatttattatatggaaaatgaaaaagatgagtattttattatttcattaatatatttaaatttattgacaggaataatatttgaaagaatatttgcaattgagacttggggaataactaactcaattttaagatcactaatattaatatcaattttaaatatcaatcggatgaaaagctacattacagttaggagaaaaataattataacaaatatagttatagtatttagtattattaatacttttatagaaagatatctaataaagagatatgttgaatatatgaatttaatagtaattataattattttatcaattattattaattttatatcaattgtatttttgactaaaaaggccattaagaatttagatgtactatattcttatgtatttataagtatttcattattagcaattagaaaatttattattatatatgaaatattcaattttccaaccaaaaatgattttcaaatatttaagctatacatggctttaactaagttttcatttgtatttatagtatgcggggtattcatgcaagtccttatgaaaactaaggaaaatgtaaaattaagttctgagttaaaaatattttatagattagctgagtttaattgtagtgaagaaatagcgctatttgatagtaatggagaattatgctatgcaaataaaaagtttagagaagcaagaagtaaatctaaagatgaatcaaagcagtatcaagatattagaaggattttaaatgaaggtggatataacactttaagattgattgaacttttaaaggaaaatactgatgtaaagaaaattatggaagcaaaaaatattgataggatttttgaagtttatggtcagaaaataatcacacataataacgatatttattatgcatttaaatttaatgatataactgaagagtatcgtaaaaatgaagaaactaaaaataatgaaaagatattatcagacataatagatgatatacaagagatgataatagctcttgataaggatggaaatattatattttcaaatttaacggctaagaaataccttggagatattgattttaagcaaaataaaataaggtattctagtttaataaatgaccaaaatgagagaaaaaactttgaaacaaaaataaatgaaaaaataagatattctataaatatagaagagggaaaagtcttagaaattgagtctataactttaaaaataaaagataaagaaatatctaaagtggacaaggtaattttagctagaaatcctagtgaaagtagtaaatataataatctactattagagtatgataaatttaaggagcaggaaagaataaaaaataattttattataaatttatctcatgaatttataacacctataaatgttattttttcagtaattcaattattagaaaatattgatatatctgatcacgaacaattaattagtatgtataataagtataggagacctgtaaaggtaaattgtttgaggatatatagaactattaataatataattgatacattaacattagattatgaaaatagtgatgtacaatttaaaaatataaatatagttgaactagtagaggatattgtaagttatattactaaatattttaataatattaatataatatttgatacagagtttgaagaaaaaatagtaagttgtgatccaagtaaaatagttagggcagttactaatatactagctaatgctattaagttcagtgataatagtagtgaaatacatgttaatattaagtatgaagagcctatgataattattgaatgtattgataaggggataggtattagggaagagatgcttgaaaatatatttgaaccatttttacaagttgatgactctttaaggagagaaaatgaaggtagtggaatgggattaaatattgctaaaaggctaatagagctacacaatggaaatatttctgttgaaagtaaactaggtgaaggaagtacttttagaataatgttaccagataattgcttgaaagattatgatgataatatagataaaatttacaaagtagatagtaaagaaatagattcagagttatctgatatatataatttatattaatttaaacaccagcttaaaaggttatttattttaagctggtgttattttattaaatattatagggacttaagggagaattaaaagaagaggtaaattgataaagttactgtaaaaggtaaagttgatactaataaggttggtacatatagtattaaatattcagttagtgatagtgaaggtgatgagacaactttagaacaaactgttattgtttgaagaggttaatgataacaaggttgctgctccaacaatgactattaacaataatggacaagaagatggaaaattagttattactggaggtgagttagaaatcttacttgatttaatatctgcagttgactattaaagaataataaattaaattcttagattaatatatagtttcaactatacattaagatataaattagttataccacaaggataacaggtttagggtgatgcttatggttattatataaaaatagataggagattatttaaggatttaactataggtaaaaatataattaaatataattaactggaaattaacctcatgttaaccaatttaatcaaaataatggttattatattttaagtagggaaaaactaaaatcattaaattattaaaagtatgagggaggaaattaacaatgcataggtttaaaaaaataggggtaatagcatcattagtggcaactatgacttttagtatgatagcctgttctagcaataattcagaaggtggaaacgcggaaatagacacagtagtagctagtaatgaagtatcacaaaaaacatctacggcgaagtatatatttatgtttattggggatggaatgtcttatccacaagtaaatggtgcacaaatatataacggaacagttgataataaggattcagttgaattaacaagattaggatttactgaattcccagttacaggctcagcatcaactcaagactcaacatcttttgcaccagattcagcttcaacagctacatcaatagcttcaggagttaaaactcatagtggagttataggattagaagctgataaaactacagaagtaacaacaatagctgaacaattaaaagaaaagggatataaggttgggatagtttcaacagttacattaaaccatgctactccagcagcattttatgctaatgtagaatccagaaataattattatgacatagcacttcaaatggcagatagtgattttgattactttgcaggtggagaattggggcaacctacaggtaaagataaagatcaaagagatatttatgaaatattagaggaaaagggatatacagtaactagagataaagatgaaatattgtctcttaacaacgaaagtggaaaggtgtatgcaattaatccggagttagttgggggcgctatggaatatagcattgatatggatgaaaattcgttaaaattaagtgatttagttagcactggaataaatgttttagataatgaagaaggattctttatgatggttgaatcaggtaaggttgactgggctgggcatgctaatgatgctatgagtaatattcaagatgtagtagcacttgatgaagcaatttcagaagcagttaagttttataatgagcatccagatgaaactttaattatagttacaggtgaccatgaaacaggtggtatgactttaggccaagcaacaactggttatgatactgcttttgatttactttcaaatcaaaaaatgtcttatgaagcttttgatgaaatattaaaaactcacttggaagctaacccaaatgcatcttttgatgatattttttctttagttacagaaaactttggattacttaaagaaggagaagatgataatcttttagttttaactgaatatgagcttaataaagtaaaagctgcttacgaagaaacattaaaatcagcagaggaaagagctactggtgaagaagctactatattatatggaggatatgagccattaacagtaactttaactcacatattaaataataaggctggtattggatggacatcttattcacacacaggattaccagttccagtttatgcaataggtataggttctgaagaatttaatggattctatgataatactgatatttataataaaactgctaaaattgcagggataaaataataacttaacttaaattatatattataaatttttcaaattagtcaaaataaaaaaataaaacatatatcttatacaattaaaagcttatacaaaaattttttaatatatattacaaaataataatttatctaaaagtattatagcttcttatatttcggttaatgtagcagaaatataaggggctattatattaaaaaaatttgaatttagaggtaattaaagtgaagtttaatataaacaattttttaaaaagaaaatttaaagataaaaacgtaatattttcattgatatgtttagtagcaattatagttttattattaattccaacaggattccaaaaggcgatttacacaaatgcagaaggtgtaaaagttaaaatattagaagtaaataatgatagtataataagttcaggacttatacaatcaggagaacaatctgcaacaataaaagtattaagtggaagttttaagggtgaaattcatgaaggtgtaaatttattaagtggttcattagaaactgacaagatatttaaggctggagattatgcatttgcattaatagaaaggactagtaatgatgaatttctttttgcaaacttagtagatcattacaggttacatttagaagttttattaataggattttttgttgtattacttattatattttcaggtagtacaggggttagaactataatatcatttgtatttacattgatatgcatattaaaagtatttgttccaatgcttcttaaaggatatcatcccatatatttagcattgattataggtattgtgatatctacagtaactcttatattagtagggggatttaccaaaaaagcttatagtgcaatctttgggtcaatagcagcatcacttataacttgtgtacttgctattttctttggtaatttattcaacattcatggatcaatattgcagtggtcagaatctcttatttattctggatatcaaaacttaaatttaactttaatatatcaagcaggtatttatttatcatgctcaggagctatacttgatttagcaattgatatatcagctgccgtagaagaggtagttgataaaaaaccggatatatctaggaaggaaatattattatcaggtcttaatgtgggtaggtcagttgttggatctcaaactacaacattacttttagcttatatgggaagctttattggagtaatgatggtttatatggcacaagggacaccacttatgagcatattaaatacaaaatttatttcatctgaaatagtacaaacatttgtaggctgtataggtcttgttatagtatcacctttaacatctgtaatctgtagcataatttatacgccaaaacataaactttaaaatttagacccaaatggtcaggaaattgcactattggggtttaaattttttttataatatatagtatttaatattgacttaacaataattacataaatataagaataaattgtactgtttacattattgtttattgttacaatttaaattttatttattttataaaaaattgcaaaagtaaataaaatatgtcaaaaaataaagaaaaatatgatataattattataagtttataaagacagttaagttgaggtatttacatggtaaagagaatagtaaacgtaattataaatgatttatcaagaagtgtaagttatagtcaagagcaaagggagcatattgaatatactttgactgtaataacttatgaattaataaagcttattttgatagttttaattttatatatgttaggacttttaaaagaaggactagctgtattattaacaataataataactaaaccatttattggtggatatcatgaagatagccagataaaatgtttttttgcaacaatgacaatagtatgtggcgtgcttatattaggaagaaatattgaattaaatatggtatctattattatattgaatatatttagtatattttgtatatatcatagagctccagtaatcaatgaaaaaatgccattaacaaaagaagagcttataagaagaaatcgaaaaataggtttagttaatgtatctttattagcaatgctatcaatcattagttataaaagtacagtatatggtgagcttatatgtcttactaatgttgtacaaactatgctaatgtttaataaatataaaagaaaggagtgattataattaaaatggaccctatatagtagacactcaaaaaaagagtatctatctatatagagtaagtgcggtaacgtatgtagctgactgatactaataggtcgagggcttgaccaaatattaaaaataattcatatgcaattttcagagaataaattctctaagaataatccgcgatagctcaatggtggagcattcggctgttaaccgacaggttggaggttcgagtcctcttcgcggagccaaataaagctagaagtaattctagctttatttttttatataaataaatgaaaaatatataaatttatcatttatttgagtaaaataaaaaataattaatctaatattaataaggggtaaaaatatggaagttataattattggagctggtaaggttggatataccttagctaaatttctttctaaagaggaggataatataactgtaattgataataatattgatgcattgaattctataattgaaaaattagatataatggggataaaggggaatggaacaagcttaaaaatacttcacgaagctggtataagtaaagctgatttagttatatcagttactggtagtgatgaagtaaatatgctttgctcattagctgctaaaaaattgggtgctaaatatactatagcaagagtaagagcaccacaatattctgaagagatattaatgcttaaagatgaattaggaattgacttagtaataaatccggaaaaggaagctgctttagaaatagcaaaattaataaaattcccatccgttagaagtgtagatacatttgcaagaggaaaagttcatttagtaggatttacaatacttgagggtgatggattagatggagaagccatacaaaatataaaatatttaaaggattctatattaatttcaggcgtagaaagggatggcgaaatatatataccaagtggtgattttgttttacataagaatgataaattatatgtaataggtgaacataaaaaaattaaagtttttttcaaaagattagggaaatttcaagataaaataaagaacccattaataataggtggaggaagaattacacattatttagtaaatataatagatagcttacgagtaactgctaaaataattgaattagacttagataaatgtattgaattaaatgagactttaccagaagcaattgttataaatggcgatgggactgatcatgaattattattatcagaaaacctacaagaagcagatgcttttattgcgttaacaggtagagatgaagaaaatgtattaacgtctttatttgctattaataataatgtgaaaaatgttataactaaggttactagatttaattataatgtaatagctaaaaatgtaggaatagacactataataagtcctaaagctataactgcaaataaaatattaaaatatatacgttttttaaagaataaaaagaagtgttgtatagaaaatatttataagatatttgatgaacaagctgaggctattgaatttttagttaggaaagatgtgaaatttttaaataaaaaattaaaagatataaatataattagtgatataattattgctactatagttaggaatgataagataattattccatctggggatgataaaattgaaattggcgatagagtaataattataactaaaaaagataaacttgttgatattaacgatatagtagtgggaggtcataaataatgaattttcctgctatattaaatatattaggtcatgtaataaaatatgaactattattattattaataccatttgctgtagcacttttttatggtgatggagatgctagtgcatttttatatacgatattaataatgattcctatatatataattcttataagaataaagggaaaaaagaaacagatatacgctaaagaaggatttttaactgttgggttagcatggatagtaatttcattttttggagcattgccatttatgtttaatggtgctattccatcacttgtggatgcattttttgaaacttcgtcaggatttacgacaacgggcgcatctatattaacagaaattcaatctttaccaaaaggaatattattttggagaagttttactcactgggttggaggaatgggattccttatatttatattagctttaatgccatcatttggtggaaatacaatatatttattaaaagcagagagtccagggcctactccaggtaaaatagtgcctaaaattaagcaaactgcaaaaatattatatgcaatttactttgtattaacagttatagaaactatatttttaaaatttgcaggtatgtcatggtatgatgcaattatacatgctttagggacagctggaacaggtggattttctaatatgaatgcaagtgtagctgcatttaataatccaacagtagattggattatcacagtttttatgcttttatttggtgtaaattttgttttatatttccaattaattaaaggtaattttaaagcattcttcaggagtgaggagttgaaatggtatttaattgctgtttttggagcaattgctattatagcaattaatataataccttttaataatggagatgtaactaggtcaataagagattcggcattccaagtggcatctgtagtaactacgacaggttatgcaacagcagactttaatttatggccaactcttagtaaaatgattttggtaatgctaatgttcatgggagcaatggctgggtctacgggtggaggaattaaaactgtaagaatagtaataattattaaagctataagaagagaaattgataagatattacacccgcgaagagttaaaagtgtaaaaatagatggaaatgtagtagaggaagaaactatatcaggagtatttatatttatatttgcatatatagttattgcacttatagctatatttatagtttcttttgataattttgatgttactactacagtcacatctgtgatagcaactttaagtaatatatgaccaggacttgaaatggtagggcctacaggaaactattcggctttttcagatttaagtaagatagtattatcgttttgtatgcttgctggaagacttgaaatatatcctatgcttatattatttagtccttcactttggaaaaaaagatattaatatttgcctctggggtcaatccaaaaaatggattgaccccagaggcattttaataataatatattaagtatataattaataatagtgaaagggaggaatgttttatgttatctcgtgaaattgcacaaaaggtgcttggaagatgtttaataactggtggggattttgctgaaatatttgaagaagatagtttagacaactcaattagtatattaaatggaaaggttgaaaattctataggaggaagaacttatggaattggaattagaatatttaaggggttaaagagtgtatatgcatatacaaataataatagtttaacttcacttttaaatgttgctcaaaaggctgcaatggcattaggtgaattaaaagaagaaaaaatgatagttattaatgaaagagaaaatataaatttaaatccgataattataactccatcatctatagaacttaataagaaaattggtgtgatgaaagtagcatatgatgctgctaaaaactatcacagtgaaatagttcaagtaggagtaggatatgctgataaagagcaacatatattaattgccaatacagagggattatatacagaagataagagaacaagaacaagattaactgtaaacgctatagcatctgctaatggagaaaaccaaactggttttgaggggccaggaagacatatgggatttgaaatgtttaatgaagtaaatcctgagtattatggaagagaggctgctaagcaagcatatactatgttacatgctaaaaattgtccagcaggaagaatgacagttgcaatagataatgggtttggtggagttattttccatgaggcttgcggacattcactagaagctacagctgtagcaaaaggaaattctgtgttcacaggaatgttaggaaagcaaatagcatctacaaaagtaacagcaatagacgatggaacaattccaaatgcatggggatctttaaatatagatgatgaaggtaataagactcaaaagaatgttcttattgaaaatggaatcttaaaatcttatatgatagataaattaaatggacgtagaatgggtatgaaagctacaggaagtggtagaagacaaagttataaatttgcacctacatcaagaatgactaatacttatattgcaaatggtgatgataatccagaagatataattaaatctataagcaatgggttatatgctaaaaaaatgggtggaggatcagttaacccagttacaggggaatttaattttgctgtttcagaaggatatctagttaagaatggtattattcaagagccggttagaggagctagtttaattggtaagggtagtgatatattaatggatatagacatggttggtaataatatgactcaaggtcaaggtatgtgtggatcatcttcaggtactatagcagcaaatgttggtcagccaatgataagagtaaaagaaataacagtaggtggaagataggaggggagtatatggaactaaatttatttgtaaatagtttatttaaaaaagctaaagaggctggattcacagagtatgaagtatattatgttgatagagaaagcttaagtattagtgtttataaggaagaagtagaaaagtacaatttaaataattctgcaggattatcttttaggggaaaatttggagatagaatagggtattcttatacagaaatattagatcaagatgctatagaaatgcttgtaaaaaaagctaaggaaaatgtattagcaattgaaaataatgatattcaatttatttatgaaggtgatagggaatataaagaaatcagtacttatcatgatgctttagaaaatttagcaccagataaattaattaatattgcaataaatatggaaaaggaagctaagaaatattgtgataaagttgaaagctttagtggatgtgcaatatcatatagctcaggaaattatggaataataaactctaagggattaaacttaaaaaacaaatctaatttattaacagcgtatgttgttccaatagtaaaagatggggataatatgtatgatggctgtggatatgtagttgctaaatcattagatgaggttgatcctgtaaaaatagcaaaaatgggagttgatgaagcattaagtaagattggtgcaagttcagttccagcaggtaattataaggttattataaataatgaagcaatggtatcacttttatcaacatttgcaggaatatttagtggagatgcagttcaaaagggattaagcttgttaaaaggaaaagaaggggaaaaaatagcttctgatatagttaatttagttgatgatccgcatttaaaagatggtttagcatcagttgcatttgatgatgaaggtgtggctacagcaaaaacttatttaatacaagatggaaaattaaatactttacttcataatttaaagactgctaataaagcaggagtaaaatcaactggtaatggatttaaatcatcatatgcttttcctatatcagtatcaccaacaaacttctatattgagccaggagttaattctttagaggaaatgactaagaaaattgataaaggattaataattacagatcttgcagggttacattcaggtgcaaactctataactggggatttttctttagcagcaaaaggtttttatgtagaaaatggagttaaaactcatccagtagaacaaataacagttgcaggaaatttctttacattattaactgatatagaagaagtaggtagtgatttgaagttccctatgagtagtgtaggtagtccaagtgttatgataaaggagctttccatcgcaggagaggggtcaaagaatgaataaatatgacttagttataattggagcaggagcatcagggttatcagcaggagtaagtgcattaaagtctgggattaaagatgttttaattttagaaaaggaagatgtattaggtggtaatttaaatttatttattgataatgggtttggagaatattatttaaataaaactgttactggtccagagcttggaagtattttaataaaggattataaagcgttagaaggaaaatacaaattaaatacaagggttttagaaattaatagagataaagttattacttatgtaaacccagaagaaggaattcaagaaatagaagcaaaatcaataatattagcggctggatgtagagagaaatatacgggtaatattttaattcctattcataaatttactggaatatttactactggatctgcacatagattagttaattatagtggttatttaccaggaaaagaaacaattatttccggaaatgatctatggactcttattgtggcaaggagattagtaatagaaggcgcaaaggtaaaaggaatagttacggaaagaaagtgttttaatagagatgaactagaaataattaatggatttaatatacctataatatatcaaagtgaagttattgatattgagggtattgagagagttaatttagtaaggattaaaaacctttataatgaagagattaagtctattaattgtgattcattgattttatcagtaggatatttacctgatagtgattttgtaaagaaaattagtattatgatggatggaaattatataaaaaataaagataatcatacatctgttgaggggatatttatatctggaaccatggaaaagggaattgatgcattattaaacagtggtgaaaatgggataaaggttgggaaacaagcagcaaaatacttagaagagttgagagtgaatagctaagagataaggtagaaactccttagggagtttctacaaaaaaattataactggtcatttgaaatttactacactgctattttagttattcattatagcttgaagctgatgattagtattactttaaaaattacaaaactaattagttaaatttattttcagcagtttctactagtaagtcttgaccttcagggctaaaatgaatgccatcaacgtatagatactcatgttgtttggcatctattgtagcagaataaaaatcaatatagtctaatgagtatttattacatagattaagtaaagcctcttttaaacgtggtaaattatcttggcagtaatcgtaagtatcacatttcataaaaagtttatttgctagattgggtattatatttggaggaaaacctataattatatttatgttttcttttaatgaatccttaaccattaactcaatattatcagtaatagattgtacacttctgttagaaagtaaatcatttgtaccacccataataaataaatcagtgggatttaaatcgagtacatccttttgaaatctaacaagcatatcggtagtcgtacttccatttacacccttattaaataaagataaattatatttagtttttaatttataaacccaattatctttaggttttacaccataaccataaattaaactatctcctaaaaatacgtattttctcataagtaattaacctcctttaaaataacttattaaaacaatttttacaaataagagttttacctttatcggcagtaacgaaattactttcttttaaaatacaattgcaaatagaacacttctttgatgaggataacctttcttttggagaagatgagttatttaatttgcttttagtctttgaaatttcagtagatttttttaatgaagaatataatcttttttcatcacaagtatttttttctataattgaatatgaaattgaaaatttactttcaccaaaaagttctaattcaaatcttggattttccttatcataaaactcttcaacaattattctacgaatctgagcatcattgactataagtccacttttttcaattccatcaaatatacttttagttatatttgcagtatcagggtgacgcttttcacttttataataaacttttaatactgctataagtgattcttctaatattatttctggattttgacttcttgcataatatgctatttcttcttcataaagagcatatttatcatgtgattttcctgtattataaggtaaaatagctctaccatctttattatgtaatttaaaatttgatttagtaataggcgagcctaaaactattacttttgcataaggtttcatatgtaattctcctaaagttttttaaagtaaagtgtatataatataaaagatgttaataattattaatggataacctaaatgaaaaataattattaagaaatccttaaaaatccataaaaagaaataaaaaataatgaatattttttttgaaaagtatataatactcattagtattaaatctacaaataagtatttattatatttcaactatacatgagagaatttatattaacaagtaataatttgattatgtaatacgattacgatataatacagattggtattattcagtaaaaaagaagaggtaagaatagatggaagataaatatattttagctatagaatcaagttgtgatgaaacttcagcagcagttgtagtaaacggaagagaagtattgtcaaatgtaattgcttcacaaataagtacacatgaaatgtatggaggagtagttccagaggttgcttcaaggatgcatatagaagctgttagtggagttgttgaagaagctttattagaggctaatgttactttagataaaattgatgcaattggtgttacatatggaccaggattagttggagccttattagttgggttacaatttgcaaaggggctagcattttcaagcaagaaacctttaataggagtgaatcatattgaaggacatatttgtgcaaattacatacagcataagaatttaaaaccaccttttgtttctttagtagtttcaggagggcatacttttatagtccatgttaaggattatggaaagtatgaagtaataggtcaaacaagagatgatgcagctggtgaagcatatgataaggttgcaagagctttaggacttggatatccaggtgggcctaaaattgataagttagcgaaagaaggaaatccaaaagcaatagtatttcctaaggctaatttccatgaagaaacattagatttttcatttagtggtgttaaatctgcagtacttaattatttaaataagtgcaaaatgcaaaatattgaagtaaataaagctgatgttgcagcatcgttccagcaagcagtagttgatgtattaaaagataatgttttattaacatgcaaaaagaaaaatgtaaaaactattgcaattgcaggtggagttgcttcaaattcaacattaagagaaacacttactaatgctgcatcaaagagaggaatagaggttttattcccagcaccaattttatgtacagataatgcagcaatgatcggaagtgcagcttattttaattttgttaatggaaaaattagtaatttaaatttaaatgctaaaccaaatttaaaattgtagttatgtagatttgagtatacgatttgtagagggatacatatacttaaaaaacttaaatatatttataaaaaatataagttaaggatgtatggggagagaaggcaatgaattttttaccttattcaaatggggtacgtaaagtaagtatgaaaaaacatagaagtcctaaagaaaaatttaaaattgtagtcattataatggttgctattttaattattgggattgttactcaaaatgtggttgactttattgatggggaaagattaaaaaagagggtaaactatactacagtagatgaattaagaatggattacagaattgaaggggaaggtagctatactattatttttgatggtgatatcgggactactttagaagaatggacacctattgtagaagaattaaaagaaaatgatagtgttagaacttttgtttataacaggcaagggtatggatatagtgatatatcatcatcgggaaggacaccggaagagcaagctagggatttaaaaatattattaagaaaagccggactttctggaccatatattattgtaggtgaagggtatggttctttggtattaacaagctttgcagagcaatttaaggattcagttgcggcagccataatgattgatcctattaatgaacaagttattcaaacaaaagattatagaaaaagtcaaacgttaactaaaatacgaagaagtattgaaaagataggttcaaaatgtggacttacaatgttattagataaattaaatttagatgttaatttagaggattatgaatcaggtcttttagataagaataaagaggaatttttagcactaagaactaaatcaaagtatacaacggcagtttataatgaacttaaaaatatactgactggtacaagcaacagtcaagttgatggagtgttttctgatgtgccatattatttattgactagagatgagaatgatccattgaagagtttaggtagtgaagaattaactgatatatatgtaagtagctgtgaaaaagattatttaccattaaatgataaagataatgttttgttagctataagacaaacggttaaaaaactacaagaaattgaagcagcaaataaagcaagtaataaaaattaaagccgataaatatcggctttatttttttgataaaaaagaattaatatttactatttgtcatatatttgacacatacagtggttatattataagtatcaaataaatgaaaaaataatttaaatataaattaaaggagttagtatatatggataatgagaatatttatgacgctgcgtatagtgagacacagataatcgaagagggggaagtaaaaagtaattttgaagaacaacataagaaaaaaaatagtaagaaaaaaagaggaaatggaaacggatttgctaaatatatcgcaatagctcttatttgttctttatttggaggagtaattggttcaggaattacttatattatagcaggtaaaggtagtagcactactcaatcaaataatagtgtagtaacagatccagtatcttttgcaacagataatgcggctttatctgcagcagatatatataagaaagtagcacctgcagttgttatggtatcaacaaaatcagttcaaagtgttaatggttggttccaacaagaaactgaaggtatgggatcaggatttataattaatgaggatggatatattttaacaaactatcatgtaattgatggagcaaaggaagttacagtaacattaagtgatgatagagaagttacagcttcagtggttaattatgatgccgatcaagacgtagctatgataaaaattaatggtgatatagaagttcctggagtagtagaattaggagattcagatgcattacaaccaggtgaagaagtattagcaattggaaatccattatcaaaggaattatcatcaacattaacaaaaggaataataagtgcattaaatagaagtgttgaaactcaatcaggtgttagcagtaatttaattcaaacagatacagctattaattcaggtaatagtggtggtccattaataaacactaaaggtgaagttattggaattaatacattaaaagctagtgatggagcagaaggtattggatttgcaattccaattaatgatgttaaagataaaatagattcattatctaagccaatactaaatttaggtgtttcaattagagtagttgatgaatctttagctaaacaattaaacttagaagaaggtttatatgttgtagaagttaatgaatattcaccagctgaaaaagcaggattaaagggtggtgacttaatagttaaagctgatggtagtagaataaagacttttgaggagttacaagaagttaaaaactctaaggaagaaggcgatactattaatattgaatatattagagatgggaaaactaaaaatgctactataacattgacatcaacatcatcttcagaatcaacaacaaattagtaataagttataaataaaatagaccatgtggcttagtaaggctacatggtctatttatttttattttaaaatgtgttcataagcttttaatgtagaaatagcagtattcttccaagtgaagtttaagctatttttataacctctctcaccatattcaattaataaatcagaagaatttaataattgaagcattgaagaagctaattcatccttgttgtttggattaattaaaattgcagtatcagaagtaacttctggtattgatgtcaaattagatgttataacaggagtaccacagctcattgcctcaagtggaggaagaccaaaaccttcataaagtgaaggataaataaacagttcacatgcattgtaaaaataaggtaaatcatcatctgtaacaaagccagtgaatattactttatcatcaatatatagatctttacataagctttgcaatttgacaccttcatcacggacagagccacataacacaagtttataatctttatttagtgatttatatatgctattaaaggataatataagctctctgacattttttctagtactaaaaccacctatatataataaaaatggtgaagaaatatgatatttattttttatataatcaatgcaaacttgtttatctaaaggcctataattggaatttgcggctaaaggggtaacaaatattttatcttcatttactgaaggaaagaactttaatatatctttctttgagtattcagatacagttaagattgctttagaattattaactattaggggcatatccctaagaaatctttctaaatatcccctaccaacagtctctggtaagatataaggtattaaatcatgtatagtgactattactggtgaagtatatgatgtatttaatccaattccattttgaggtatatgatgtaaatctatattattttcttcgatataacttggatagtaataatcttcatagaatgttccatgtttttttgaagtaaaaattatttttgaattatcttttttaaactctctataattttcacctgcccaaaaaacagaataagtatttttttgatctatattaagaagctctctgagaagattttctgtgtaagtacctataccagaacccttatataaattaatccctctagcatctattgataatttcaaagcataacgcctcctaaaaaaacctataatattataaatattaaattaaagtaatttatgtgatagtaaacacaatgaaataaaaaatttcatataatacaaggaagaaagctttaggagtaagcaatgaataaggaaaagttaaaggaatctatagaatctaattatgatattaaggtgctagctatagagaaagtgaaaaatagttatagattagaaactgaaaatactaattatgctataaaaataatagagtatgattttccacatttttattttattttatctgcaatagaacatcttcaaaaaagggaatttcataaaatacctaaaatattaaataataaggatggaacaaagtatattcaattggaaaatagttatgcttatttaacagaatggataccatctagagtaagtaattatgataatcctattgaattatcaaaggttgctcaaaagctaggagagcttcatacctgtagtacaggttttaatataaataatgatatgaaaccaagaataggatggtattcatggataaatgtttttaatacaagatgcaatgagatattggattttaaaaatagaataaaccaaaaagcatataaatcaaaatttgattatatttatttaagtaatatagaggcagaattagagagaggaaaagaatcaatagaaaatttgaaaaggcataaatacattgaaataatggataaagaagtaatgaagatgggattttgtcatcatgattatgcacatcataatatattagttgatgataatgatgaattgaatattattgattttgattattgtattttagattcacatttgcatgatttatcatcattattaattagagctatgaagggtgctaagtggggtaaggagaaggcagatttaattattaaaaattactgtaaaagtaatggattatatgaagatgaatttaaattaataggtgattttataaggtttccacaaacattttggcaaataggtattcagtattattgggagcaacaaccttggggagaaagtttttttgaagaaaaaataaataaatatctagaagatgttgagtatagagaagagtttttagattcatatttcaaataaagaggtggatgatatttggatataatagaatttttaaatggtaatggtattattgttggagaagaaaactttcctaggggtagtaagaaaaaatatatgtgggatatcgaatatcaaataaagttaatggtagaaattcaaaaaataatgatgggaaaaaaatcatatataattcctaggatagaaagttcaattggacatgaagtagaaacatttattgtacaagctaaaaaaacttctaaaatgttaaagttagttgaagaaaaggtttctaaaaatgattttgattattttattattgaggaaggaaagaaaattttagatagagctaataggtctttagatacattagatgagaatgaatacttaaaaataatagtaaggagtatgaataattatgaggtatgcttaggaagagtagatgaaggaaatttaaaaaaagaaggaatggcaatttgtataagaacaataagatatatttcatataatatgattgaacatgattgctatagctatataaaaaggttaaaaagaagggggtatagtggagatattgttaatataataaataagtttgcagaagaggcaagattggaaagtgaaagcaaaaattatattaaagtactagcaaattatcctgtagagtcaataaaagtattatcaaaactaaggtacgatagggaacgatttaccgatgatgaatgggtaaaggagattaatatgtctcaaagtatagatggtattgagcttttatgaatggaggaacaagatgaataaatttagatatatagataaaaaaatattatgtagctatgacttaagcgaagaattttttcaagagctaggggtaaaggtatatgatattattcccttaagaaaagtatttgtaattttcacagataagggtaaaaaaatattaaaaagaattaactcatcagaagaaagagttgaatttataaataaggctttaaatataatcaaagaaaaagataattatgtacttcaatattgtactaattcaaagggagaaataatcactaagtggcatggaaaatcttttgtattattagatatgatagatggaagagaagctacatttacaaaccctattgaagttgaatggtgtacgaaatctttagctaattttcataaagcatcaaaaggaataattaataatttaaatgaaaaagaagttaatttaaacagttcaagaaatttaatttatgaatttctaaatgatttatgtattataacagaaattgaaagagtagttagcaaatttaattataaaaatgaatttgatttaatatttctagataatgtagcaaaggcaaaaaatgatttaaataagtgtattaatttattaactgagggaccatataatgcgttatatgttgaaaaggataattatgtattatgtcacctagatttggctcatcataattttataatagaggataacgaaataaacatgattgattttgattattgtaaattaggcataaaggtgctggatatatataattatattgttaaagttataaaaaattatgcctataataaagagatagtggttaaaataataaatgattataatgaaatttttgaaatatcaattaaagagaagaaaataatttttgcattattaaattatccaagggactttataaatatttcaatggattattatttaaaacaaaagtcctgggatgaagaggtgtttattagtagatttagggataagattgaaaatgatacttttagaaccgaattattaaggaacttaaataaaaatttagaataaaattaaagggactatgctaacgcatagtcctttttgtgtatattactttataaaaataagtgttagaactttattatgctttcataagcctttatagtatttaaagctgtatttttccaagaataattattgctagtagacaaacctctttcaatcatagtcaattttaaaaagctatcagtcaatacacgctccatcgaatagcagagttcatcaatatcattaggatctattagtatagctgaatttctacatacttctgggagtgaagtgacattagaagctattaccggtaccccacaagccattgcttcaagtggaggtagtccaaatccctcataaaatgaaggatatactaaaaattcacatgcattataaaaaataggtaaatcatttaatggaataaagtcagtaaatattactgaattagagatacctaattctattgctttatttttatagatttcatatgatattccctttttacctgttattacaatttttaaattttcttttaaattatcttttaaaagagaaaaagcctctaaaataccaattatattttttctagggctatatcccccaacatacaaaataaagttatcagttatcttgtaattatccttaataaattttttacaataagccctgtcaattggtctataaatatcttcagcggcaagatgtgttacaaaaattttttccattgggaaattaaattctttggctatatctagctttgaaaattctgaaactgtaattatgccatcacaattatctaatatttttggcatttcttcattgaatattcttaaataacggtcactaacagtctgaggcattctaagtggaattatatcatgtaaggtaatggtcttaggacaattaacattgccagaaaggcctacaccattttgaggaacgtgatatagctccatattgaaattttcaagtaaattaggaacttttacatcatcccaaaagttattgttagaggagtcttttgtatattctatggagaaattatctttaagatttaaatcagaatcttctgggatgaaggtaagataatgatttaaattgtcatatttgcttaaattggtaataagctgataagtgtaggttcctatacctgttcccctataccattttgcggctcttccatcgataccaatcttcatgatttaatcctttcaaaatagttataatttattatattataataatttaaaaatgttaataaaagtagagatatgtacatataaatataaagggggtgaggaatatgatgagagaatttgaaatagaaagacagtttcaaataaaaatagatataataaaagctaataaaggtatctattatattaaaactaataaaggtgagcgatgtcttaaaaaaatcaattatgggccacaaaaacttttgtttgtttatggtgcgaaagaacatctaataaaaaatggatttgacaatgtagataagtattttttaaatatagatggtgaaccatatgcattagttaatgaagatttatataccttatcagagtggctagaaggaagagaatgtgacttccataacatagaagaagttaaaattgcagcacaaactttagcaaaattacatgaagcatcaaagggatatgatcctcctgaaaactcaaaattaaagagtgatctaggaagatggccaagcctcatggagaaaagaatcaaatcattagataagatgcgtgatatgataaggaaaaaaaataggaagagtgattttgatttattgtatttaaagtcaatggaattttataaggaaataggaaagaaagcattaaatactttaaattcttctgagtatattaaattatgtgaaattgcagaacaggaaaagagtttctgccatcatgattatacttatcacaatattattttaggtaatgataattctgttagtgtaatagactttgattattgcaagagggaagtaagaacatttgatatttcaaactttatgataaaagttttaaagagaaataagtggaacatagattttgcagatgcaattattgactcctataatagtatttcgaagttagatgaatgtgaatataatgtcttatatgcatacttacaatttccacaaaggtattggagattagctaatagatattattataatgaagtaaattggggacaaaatacttttgatagtaaattagaaagtataattaacgagaaagatgagtatttaaaattcttagatgagtttaaaaagaaatataatacaatttaaaagccggctttaaagctggcttttaaattattaagaatctatagtttgtttagttaatagttagtagttaatggttaattgttaatgaataaattcagctcagctgaatttattcattaaggaactctgatagtagttccttctttaaccattaactatttaaatatatggtgatttaggatagccttcacgatattttccacgagtttgaagtccaccaataccttttatgcctgtaattgtattttcaactatatttgttattgagactacagagtcaatgttagtataagctattttttcacaaacaaaaactgggtctaagcaatgaattaatactctactaggggaactagcaaaattagcgccagcatctaataggcattcatagcaggattgacatgcacctgcaaaaataactaattcatcataactagaattataatttctaagggccttgaccgcatctatataatattttgaatttctataattatttaaatctaagtaatcatcacttgtttttaacacactatcgtgtccggttaaaactacaatatctggtttaatttctttaactaaatcaacaacctttgtagcttgatccctttctgaaatagctcgaccaacagcatctaaagaaagttgtttataaacctttaagcatgtttctaaatagtctttgtcaccatcaatatgaagtatttttccaggacgaccaaaaattaattcgttattaggtgcttttttttgagatttactactacgggtaagtgtagtgggatcgtgcctatatccacgggtatttacagctttctttattgcatcattaactctactatttaatattttttctttttcaccaataaaattaacatcgacatgctctaaatcatcttcaggtgaatcggcaattattcttatacttatacctttaagtatatatactattttcccatccatttcttttatatcaataattttaaaagttatatccttatcataggattttcttacaacagtatcacctattaccattttattctcctaactaatacatgatttcaatctataatatgatattttaatagcatttgccccttaaatatttagtgataatttaataataatgaataaaaaactataaaaaaagcaataataattaatagataaaatgatagataaacaaaggtaaaagtttacattgacaaaactaccgtaaggtgataaaataattggttttatttgacaaaagtgctaaaaagttttataatatagttagaaagatggtggtcatatggaaggaaataaaacattagccaacataagaagagacatagaaaaccacgtaggtgaaaaagtaactttaaaagccaatggtggaagaaaaaaaatactagtaaacgatggtgtaatagaaagcgttcatccaagtatttttgttgtaagattagagagtgacaaccaaaggactgtaacttatagttactcagatgttttaactaaaactgtatctttatactatgcggtataagtaagagcttcgaattttttttcgaagctcttatttttgttagattaaatttaaataaaaaaaattgcattttatttctaaaaatacaattttattaatatacatatataagaataaaaaaaagaaagatggcgggtatccatctttcaactatggtataaaagggtattgagaatttatgagaggttatatggtcaataaccatctttataatatgacatatttataataaagtcaacaatttatttaaaaaaaaataaaacttttttattttgatactaaatttcgacatttagcattaaaaaatggaaaaaaataataggtttctaaaaagcatgatgaatttattatttaaaaattagtaaacagtttgcctatattagaataaatatatatttagagaatataaattatagtaggtatatactatggaggagggataggatgtctcagatagatgttattaaagaaagtgttcaaaatgaacagctaataagagaaaactctactaataatgtattaaagggtgaatatttaataaaggactcacatccagatgttcatcaaattttaggagtagaagcaaaagcaactattactaataaagagatactagccgataaaataatgatagagggtcaaattaattattctgtcatgtacttatctgaagatgaaagtaaggtaactagtataaactctgtttatttatcagaaaaattcgctgactaccttgatattaatgctgaagaacataaagtcatttgtgaagtagagtgtgcaatagaacatattcaagctagtataatgaatgaacgtaagattgctattgatggaataagaacaacaaaatggttactttataaaatttgtgaatttgaatttgtaaaggaaatagaaggtagagacgacatacaaattaagagaaagagtgaagagataaaccaattaaaatgtgaaaaagaaatagaaataatgggtaaatctatgattaaagtaacaatggataagccagagattgaggaaatattagcatgctcattaaatttgcataaaaaggaagtaaaacttggggaaggaaaaatttactttggttgctattgcaaaatagaagttttatgtagaggaaaagaagaaaatgatattttcttactacaagatgatgtttatttatctaaagaagaagagtctattggcgttaatggagatatgatggctactcaccaaatagaaatagtaaattcagatagtataataactgctgatgatttaggtgagaatagggttattaatgttgaatttaatgtaaaaggaactgttaaggttatatctaaggagataattgatgttattaaagatgcatattcaccaacacaatcaattgaattaacaaagaaaaaatatgatattggaatagtgcaaggagtaataccatcagaattaataataaaagataatttatatcctaaggatgaggaagaaaagatttcttgtgtagtttggacagggggatgtcctttaattactgaaacttatattgaagaagataaagttaagattgaaggtatattaaaagtacaagtactttataaagtatctgaagaggaatgtaaattagatatgtgtagtggagagattccatttacaacagtaattgatttaaagggtattaaacctgacatgagtgctatttgtaaagttaagttagaaaacttagatggaactgttgaagctaatacaatagcaataagagcaacattattaatagtaactaaggcttactataagattgaaaaagaatggatagttgatatccaagaaggagagtcagaaaaagagtgtaaaaaagcatcagtaacaatatatgttgttactactggtgatacattatgggaattagctaagaaatataatacaacaatggattcattgattaaaattaatgaattagaaggtccggaagcattagtcgaaggaaagaagataataataccaggtaaatgtaaattttaatatgatttaaattagaggtcattacagcttgatgtaatgaccttttgctatatgaatatattttgttgtattggataaaataagaaatacatgatatgaggtgataatttgagtgaaaaaataagtggcaatttaattataattggaggagctgaagataagaaggggaaaaaagagatactaaaaagagtagcaaaatatattgatccaaataaagaaaaaatgttaatagcaaccatagcgacagagtatcctgaaaaaagctacgagaattataaaaatatatttaataatttgggtataaaaaatattgaaaaattagatataggtgtgagagaagaggcctttgataaaaaaaatattgatttaattaaagaagcagatttattattttttacaggtggagaccaattaaggataacaagcatgatagggggaagccctgtatatgatgctattaaggaattatgtattaatggtggtattattgcaggaacatcggcaggggcgtctgtaatgagtgatacgatgattgtagagggaaatgatgaagagtcaccacataaatgcacattaaaaatgtcaccaggattaggtttagtaaaaaatataataatagatcagcattttgctcaaagaggaagaataggaagattgcttactgcaattgctcaaaatccagaagtattaggtataggcatagatgaagatacagcaatattagtaagtgataatggaacagcagaggtaattggttcaggagcagtatattttgttgatggaagctgtattgattatagtaatgtttcagagcaatatagcgaagaagtactgagcatgtttaatgttaagctgcatgtattaaaagagggcaatagatttaatctattaaaaaaggtaccttttgaggaggataagaatttttatgaaaatcatagatagtactgtttatgatggcagaaatattcattcacataagaaatgtatagtgttagacgttgatttggagggatattcggaaataccaagcaaagacattgaggggtttaacgaaaaattagtaagcatacttccaatattatatacacatagatgtggtatagatgaggaaggtggatttgttaaacgcttaaaagaaggaacatatcttgcacatatttgcgagcatatgattattgccatgcataatattcttggaatagatatagcttacggaaaggctagagaaattgaaggcgataaatatattgttgtatttcaatatgagtatccaagagtaggacttgaaataggaagacttgctgtagatattatcaattcatttatagaaaataaaaatatatcatttgatgatagacttaacgtaataaaaaatatattaaatgaagaattaattggacctagctcatttgaaatttgcaatgcagcgcaaaaagttggtatgcctattttaaaaatgggaaatagcggattttatcaaattggatatggaaaacaaggcaggataatagaatcagctattagtaattcaactagctgtgttgctgctgatatttcttgtgataaattacttactaaagaaatgcttagaatacagaatttgcccgtttctaggggggagaaggtaagtaatgttatagggttattaaagtctgcagagaatttaggatatccggtcgtattaaaaccagagtttggaagtaaaggtagagatgtaatattaaatattaaaactgataaagatttagtggattgttatcagaagttaactaaaaaatataaggatataatgatagaaaggtattatgaaggcgatgactatagagtgtgtgttattaacaataaagttgttgctgtatcaaagagaattccaccatatgttgtgggggatggaataaagtcaataagtcagcttataaatgatttgaatagtgatgaaagaagaggagaagatcatgaaaagccacttactaaaattaagatagatgatgaagttattagaaatttaaaaataaataattatgaaatgaattcaattttggaaaaagataaaaagctaattttgagaaaaaattcaaacttatcaacagggggattagctatagattgcactgatgatatttcagaggaaaacaaagaaatatgtgtaagagcggctaaggccattggattggatatttgtggcgtagatatttgcacaaagagtattaaaagatctttacttgaagatggtgctataatagaggttaatgcagcaccaggattaagaatgcattcatatcctgctattggaaagaaaagaaatgttggaactgaaatagttaatatgatgtataataataatcctaaaaatatacctgttatttcaattacaggaacaaatggaaagactacaactacaagaattataaatagtacattgtcaaaaatgggatattgtgttggtatgaccagtacagatggtatttacataaatggagcatgtatagatagtggtgatgatactgggtttgaaagtgcaaaatgtgtattgtttaatagggatgttgatgtagcggttttagaaacagcaagaggcggtataataagaagagggcttgcttatgatttagcagatgttgcagtaataacgaatattactgaagatcatttaggtctaaatagaattaatacaatggaagatttatgtatggtcaaatctttagttgcagaagctgttaaagaagatggatatgttgtaataaatgcagatgataagtggagtaaagagataataagtagaattaatgctaatataatttatttttcaaaggattgtaataatgagttaataataaataatgaatctaaaaataatatagcagtatatttaaaagataattatatatgtgctaaaaatcttggaaaagaatataaaataattaatattaaaaatatacctattacattaaacggaacattagaatttaatgttgaaaatgcaatggctgcttgtgctgcgttagtagcactaaaagttgattattcaatgataaaaataggccttagcaattttaactcaaatgaaaatacaggaatatttaatatttataattgtaatggaattaaagttattttggattatggtcataatatagaaggttataaaaaagtactacctacattgagaaatatcactaaggggaaaataactggtataataggtgtaccaggagatagaggtaactatgttgctaaagaaattggaaaaataagtgctaactatcttgataaaataataattaaggaagacaaagataggcgtggaaaaaatataggtgaagtagcagaagtaattaatcaaggtgttttagaaaataaaaataatattaaaacacgaattatattagatgaagtaaaagccttagaaactgcatttagtgaatctattccgggagatacaataatcgtattttttgaaaaattacaaccactattagattttataaaaactaatcagtctgatgatgaaaatctaggtaatgttgctaattcaatttaaagaatacaacaatgacatatttactatagtaaaaataatatatataatatattttatgaagttcagggtttatggctctgagcttcaatttaaaatagatactttccggttgaaaggatttgaatatatgaagataaaggcgtatgcaaagataaacatttccttagatgtagtaggaaaaagaaaagaggatggttatcacttattaaaaatgataatgcaaaacattgatttatatgatgagatatatgttgaaaagcgtaaagaaggtataactatacattgtaataaaaattatgtacctactgattcgagaaatttggcatataaggcagccatgttatttaaagaaaagtataatattaaagaaggtgtctatataaacatcataaaaaatattcctgtttcagctggattagctgggggtagtactgatggagcagcagtattaaagcttatgaataggctttttgaggttaatgcttcagatgaagaattaatgaaaattggtttaagtcttggtgctgatataccttattgcattaaaggagggactgctctttgtgagggtgttggagaagaaattacacctctaaaaccgtttaaggataaaatcttagtattggttaaacctggttttggagtgtcaacaaaagaagtatataaggcttttgatttagaaaaagcaagaatacatccaagaactgaaaaattaattgaagctatggaaaaagatgatttatattatgttgcaaataatatgaaaaatttattagaaaatgttaccttaagaaaacataatgtattgattagaataaaagaagaaatgaatagatatggtgctgttggaagcatgatgagtggtagtggaccaagtgttttcgcattttttgatgatatgctaaaagctcaaaggtgctacgaaaagatgaaggaaagtcatagagaggtatttttaactagaactatctaaaaaattaaatattataatgagatgaataaacccctttaaattgtcaataattattactagaaaggggttatgttatgaaaagatatatgtattttataatagttttaattttagtaatatttacattgaacggatgtgctcaagttaataatataaataataaggatttagagcttaatgaacttaattatgatgatataaaggacaagctgattagatttcatgtaatagcaaatagtgatacagaagaagatcaaaatcttaaactaaaagtaagagacaaggttgttgaagcattaagtgaaaaacttagtggagtagagtcattagaggaagcagagaaaattttagaagataatattgactatgttaatcaaatagcaagagaagttattactagcaataattatgattatgaagtaaatacaatgttatcatatgaaaattttcctaataaagtatatggtgattatgtatttccacaaggaaactacgaggcatttagagttataataggttctgggcaaggacaaaattggtggtgcgtaatgtttccatcattatgttttgttgatgaaagtaaaagtgatgttgattcaacaaatttaaaagaggaaattgagagcgttgaaccaaaagaggataataaagtagaagaaaatacaagtgatttaaataaagaagatgataataaaaatgatattaaaatgaaatttaaaattgttgaagttattaatgatttatttaaataattaggaggataaaatgacaaaagcattagcaatggtttcaggtggattagacagtatattagcagctaagttaataaaagaacaagggatagaagtaataggggtatgttttagatcatatttctttagtgaagcaagtgcaattaaaatgacaaaacaaatagatatacctttaatagtagttgatttttcaccagaacattttgagttagtaaaaaatcctaagcatggtagagggaaaaatatgaatccatgtatagattgccatgctatgatgatgaattatgcaggaaaattattagaagagcataatgcagattttataattactggagaagtattaaatcaaagaccgatgtcacaaaacagacaagctttaaatatagtaaaaaaagaatcaggatttgcaaataagatattaagaccactatgtgctaaaaatatagaaccaactgaaatggagttaaatggtttagttgatagagagaaattactaggtatttcaggtagaagtagaaagccgcaaatggaattagctgctaaatggggaataacagaatacccatcaccagcagggggctgtagacttactgaacctaattatgcattaagattaaaggatcttttaacatttaaagatgaagtggaagaagatgaattaagtttattaagatatggaagacattttagaacatctgacaataataaaataatagttgctagaactaaagaggagtctgaagctattaagaagcttgtaaataaagaatatttattattccatgcaacagatttttcaggagcattagttttattagataagaatggaacagaagaggataaggtattagctgcaagaatggcagcaagatatagtaagggaagagatgaagaaagagttaaaataaaatttggtatatatggaacaaggctagaaaatcatatagaagtagaaccaattaatgataatgagttagaacaatatatgatttctataaaataggaggagaatatggagaagagagcaataatatcagtaaagagtttttcagatattgatccaaatgaagcgatagaagttgtaacaccaggaacttttatcatacatgacgaaggatttaaggctatatatgaagaatcagaaatatcgggaatggatggtacaacaactacattaaatataaaggataatagcatgacacttgagagagttggatccataaatacaaatatggaatttaaagaggggttgactgctatatctttgtataatactccttatggaattttggatttaaatattgatactgagaaattaaagataaatatagatgaaaatggtggagaaatacattcaaaatatgttttaggacttgaaggtcaagagggtataactacagtattagatattaaaattaaagttaattaggttaaataggcttctgaaagtaaatatattttcagaggtctatttttatgtgtataaaagtttagtgtaaggggataattaaagaaaataaaatgttaaaaataaagggtgtgaacaaaataaataagtatgaaaatataataatgatattatgtcagtattatgaaataagttattatgaatttaataaactattaaggaaaaaggaaaaagcttatttaacagtattattgatgaaaaagtttagatgtttaaatagtgaaggagtaaaagaaaagttagggattataagtaatagaagtttgcactataagattaaaatggcagaaaaaaagatcctcattaataagaattttagggatgaatattttgaattagaagaaaaaataaaagaaaatttaagaaatgcataaaaaacactagcttaagttaaactaatgtgatactatattatttatgattattattgccttaggcaataagagaggtaatttagattataccatcattaaaatcaatagtcaacaataaaaataaaaaatagagctgggggattatgcatgaatacaaaatatgttttcgttacaggtggggttgtatcaggattaggaaagggaataacagcagcttcattaggaagattgttaaaaaatagaggattaaaggtttctatacaaaaatttgatccatatttaaatgtagatcctgggacaatgagtccatatcaacatggagaagtttttgtaactgatgatggtgcagaaacagatttagatttaggacattatgaaagatttatagatgaaaatttaactcaaaacagtaatattacatcaggtagaatttactggtcagttatttcaaaagagagaagaggagaatatcttggagggacagttcaagtaatacctcatataacaaatgctattaaggaaagagtgtacagagtagctaaagaaagagatgtagatgttgtaataactgaaataggtggaacagttggtgatattgaatcacaaccattccttgaggctataagacaaataaagtatgatgtaggcagagaaaatgtatgctttatacatgttacattagtacctttcttaggaaaatcaggagaacttaagactaagccaactcaacattcagtaaaagaattaagaagtatcggtattcaaccagatataatagtttgtagatctgaaaaagagatatcagaagacttaagaaataaaataggattattctgtaatattgaaggtaagtctgtaattcaaaacttagatgctgatcatttgtatgaagttccattaatgttacataaagaaggattagatagattagtaatagaaaagttagaactaggatgtagagatattgataatagcgaatggatcgatatggtttctagattaaaaggattaaaggggaacacaactattgcattagtaggaaaatatgttgaattacatgatgcatatttatcggtagtagaagcattaagccatggtggattagctaatgaaactaatgttgatattaaatgggtaaatgcagtagatcttactgttgaaaatgcagatgaattattaagtgaagttgatggtattcttgtaccaggtggatttggagatagaggagtagaaggtaaaatagaagctataaaatatgctagagaaaataaaatacctttcttaggaatatgtttaggaatgcaaacagctgtaattgaatttgcaagagatgtattaggatatagcgatgcaaacagttctgaaattaatccagaaacatcatatccagtaatagatttaatgccagaacaaaaggatattgaagatctaggtggaacaatgagattaggattatatccatgtaagttagatgaaaattcaaaggctcacgaagcttatgaatcatcattaatctatgaaagacatagacatagatatgaatttaataatgaatatagaaagcaaataattgaagcaggaatgaagattacagggacaagcccagatggtagattagtagagattgtggaagttgaaaatcatccatggtttgtagcggcacaattccatccagaattaaaatcaagaccaaataatccacatcctttatttaaagcatttataaaagctgctttaagtggagaatagtaaaaaacgaagggtttaccttcgttttttttatagataaatgtttgttataaaaaatatataaagtggataagcttaaaagagaagttagtattgtattttaaagagtattagttcataattatatataaatttaagtttattttttaaatttataatttatttttgtatagttatgtttcatttcaaatatatcaaaccttaaggtaaatctaatttttatccctaattaacgaaaactattggaggtgtcattttgacaagagaaatatactctgagatgactttagtagagttaaaaaacaaagctaaagaacttggaataaaaaacataagcaagttaaagaaaagtgaattaatagatgaattagtaaaggctacgcctaatgcaattgaaaaaaatggtgttgttttaagagaaaaaattgcaccaaaagcaaaagaacaagaaagtattaatagcacttataataattattcaaatagagaaagtactaataatatgacagaagaacaaagggaagagaaaaaagaaagattaaaggtaatgataaatgagtctggttcttctaaaggagttttagaggttcaagaaaataataactttggctttttaagatgtaataattatttaactggtgagaatgatatatatgtatcaccttctcaaattagaagatttaatttaagaactggtgatgaagttcaaggaaaagttagagaagctaaagaaggagaaaagtttaaagctttattattcgtagaaaaagttaatggagataatccagaaaaagctattggaagaaagaactttgaaacattaacaccagtatatcctaatgaaaggctacatttagaaactagtaatgaaaatgatttatcttcaaggttgatggatataatttgtccaataggaaaaggacaaagaggaataattgtagcaccaccaaaagctggtaagactactttgttaaaaaaggttgcacaaaatatcactataaaccatccagatgtaaaattaattgttttattaattgatgaaagacctgaagaagttacagatatgaaacgatctataaatggggatgtaatttattcaacatttgatgaagaacctcaaaatcatgctaaagtagctcagatggtattagaaagagctaaaagaatggtagagcaaggaaaagatgtagttatactattagatagtttaacaagattatcaagagcatataatttaactatcactcctacaggaagaacattatcaggtggattagatccaggtgcattaattatgcctaaaaagttctttggggcagcaagaaatattgaagagggtggaagtttaacaatacttgcaaccgctttagtagaaactggttcaagaatggatgatatgatttttgaggaattcaaaggaacaggtaatatggaagttcatcttgataggagactgcaagaaagaagaatattccctgctattgatatttataagtcaggaacaagaaaagaagatttattattaagtgatgaagaaaaagaagtagcatatgcaattagaaaagtaatgtatagagatggaaacattgagaatattacagaaaacttaataaatatgttatcaaaaacaaaaaacaataaagagtttatacaagttttccctaaaaatgatgtgtttaaaaaataaagaaaactacagaaatatgtagttaaaaatatatctagctaaaaagaggttatatacaagtattgtaataacctcttttagtagtattatgaataataaaatttattaaaaaatgaaaaaatgagaaagaaaataaattctttctcataaattctaacctaatcttatttgttaagaccgaacttcttgttgaatttgtcaactctaccgccgatatcaacgattttttgcttaccagtgaagaatgggtggcatttagcacatatatcaacttttaactcttctttaacagaaccagttgtgaaagtatttccacatgcgcacttaaccacagcatcgtgatggtattctggatgtatgccttgtttcatttgattcacctctttcaaaatacattcattgacttagcaatgacctattgaattatagcatagtcgacaaatacagtcaatataggcaggaaataaaaacatctttttaagtatttcttaaaatgctataatcgaatgagatacatatacagaggagagacattatgagtaaattatattttagatacggtgcaatgaattcaggaaaatcaacaaatcttatgcaggttgcatataactatgaagagcgtggaatgaaagttctattaattaaaccatctaccgataaaaagggtggagataaactagtttctagactaggagtagaaagaaaagtggatttattaattgatgataatcaaaatatatacgagagtgttaaaaaatggaatgatgaaaaatataaaattgattgtattttagtagatgaagttcaattttttaaagcgcatcaaatagaccaactttttgagatagcagtttgtttagatataccggttatatgttatggacttagaacagattttaaaatgcaaggatttgaaggaagtaccagattattattattagcacatagtattgaagaattaaaaactatttgtaaatgtgggaaaaaggcaatattaaatggaagaaaaataaatgataaatttgtattcgaaggagaacaagtagcaatagataatatagataatgttgaatatgaatcattatgtggtcattgttactttaaatttaaaaatcaataaaagggtgagagtgtgattttatgaaaaaatgtgatgtcggagggcaagctataattgagggagttatgatgagaggctctaaaggattagcaacagctataagaactcccagtgggaaaattgaagtagatgtaaagaaaactaaaccaattaccaaaaaatataaatttttaaatattcctatcattagaggagcagttgtactaattgattcattaattgttggaattaaaaccttaaattattcagcaagtttttttgaagaagatgaagaagaatcaaaatttgatatttggttaagagaaaaattaggggataaaggtgcaaatgatttattagttacttttactatgatgatttcacttttagttgcagctgggttattcttaggaattcctacagcaattgcttctttatttaaaaacactggaatttcttcagtagtgttaaacttaattgaagctgcaataagaataactatcttaattacttatatgtttttgataagtaaattagatgatatttatagggtgtttcaatatcatggggcagaacataaaactattttttgctatgaagctgaagaaaagcttacagtagaaaatgtaagaaagtttgggagattacatccaaggtgtggtactaatttcttgtttttaactatgcttgttagtgttattttgttttcactaactggatggggtggattttggcaaaggttaatattaagaattgtattgatgcctatagttgcaggtataacttatgaacttattaaatggctagggagaacagaaagtaaattgggaaaaataattgcatatccaggattaaaattacaagaacttacaacaaaggagcctgatgatgctcaattagaagttgcaatagaatctttaaaagcggcagagggaattgaatataagaagaaaataggggaattattaatagatggaaataaaatattaaaagaagctaatatagacacttatattttagatacacaactattattagggaaagtattaggtaaagataaactatatttaattactaataaagaagaagtagtgagtaagtttaaagagaaggaattttattctttaattgaaaagagaaaaaataaaatgcctataagctatattttaaaaacaactgaatttatgggattagatttacatgtagaagaaggggtattaataccaagaggagatacagaggtattagtagaagaaactcttaaacttatggatgaagataaagagtatgaagtttgtgatttatgttgtggaagtggtgctataggtatatctcttgcacattttagagagaatattaaggtagatttaattgattactatgatgttcctgaaaaggtaacaaaaagaaatattgtaaagcaaaagttaagtaatagagctaaatttataaaaagtgatttattattggaagttattaatagagaaaaaaaatatgatattttagtatcaaatcccccatatattaaggaagaaattattgatactttaatggaagatgttaaagattatgaacctcatacagcattaagtggtgggaatgatggattggatttttacagaagaattgtagatgatagtgataaaatattaaaagaaaatggtattcttgcatttgaaattggccatgatcaagggactgaagttagcagtttaatgattgaaaaaggttataaaaatgttagggtagttaaagatttagctggacttgatagagttgttataggaaacatgtaggtttagttaatagttaatgaataaattcagcttaactgaatttaaaatatatagttaaaaaactatgttaagagttttccattaactattaactcttaactattatagtgaaacttgataagtacacaatgattatgttataatatttcaatatgaaaaaatacagtacggagtgatattatgttattagataaattagcatttacggaaaataaatacgaagaactatcagttaaaatatcagatccttcaataatggctaaccaaaaagaatggagaaagctatgtaaggagcacgctgatttagaaataatcgtaacagcttatagagagtataagaaagttgttgaagatttagaagctaataaagagatgttagaagaagaatcagatagagaaatgagagaaatgttatctgaagaaatttctttattaaaagatcaagaagaagaattagaaaagaaaattcaaattcttttattacctaaagaccctaatgatgacaaaaacgtatttgttgaaattagaggtggtgctggaggagatgaagcagcattatttgcagctaatcttttcagaatgtatactagatatgctgaatctcaaagatggtcagttgaaatgatgagttcaaatgaaaatgaccttggtggatttaaagaagttgtatttatgattaaaggtaacggagcttattcaaagttaaaatatgaaagtggtgtacatagagttcaaagagtacctgatacagaaagttcaggaagaatacacacttcaacagctacagtagctgtattaccagaagttgatgatgttgaaatagaaatcaatgataaagatttaagaattgacgtttatagatcttcaggtaatggaggacaatgtgttaatacaactgactcagcagttagaattactcatattccaacaggaacagttgtagcttgtcaagatgaaaagtcacagcttaaaaataaagaaaaagcaatgaaggttttaagagcaagattgtttgaagttgctgaagcagaaagacttgctggaattgccgaagacagaaaaagtcaagtaggaacaggggatagaagtgaaagaataagaacttataactatccacaaggaagagttacagatcatagaatcggattaacgttatataaattagatagtttcatgaatggagatattgaagaagttattaatgctttaattactgcagatcaagcagaaaaaatgcaagcaatgggtaatactgattcaatataatattaaaagccttgcattgtataatgtaaggcttttaaaataggtgattacatgaaaatagaaaaagcattaaagaaacaaaagttttataataagatattttatataattatgatattattagcggtatttcttccattatgtacttatttagcttatattgattcagtaataatattaatttttctagcagtaatagaaattttaatttgcatagcagtaataaataaaattaataaatctactcttaaattttatttttataataataaattgaaagttaaaaatggattatttttgagttatagcttaattcaatgtgataaagtagctattgtacatactaataaaagtaatgaggatatggaaataattattattacaccagtaaggtataagaatagaaaattaaatcctatttcaaaagattttatgagaaagaataaagaggcggcagatgaatatctaagaataaaaaggatacataaagattgcttatattattttcaggttattaattgtggtgaattaaataagtatgtattactagataatatttatagaaattgtgttaatgcagtatacacgtcttctgctatagaaaatattaaaatagcaagagggcaaaaagaaatttaatgaaagaaggtaagtccttatggaaacaaaggttgccataataaaagatataaataacgatattaaatttatagaggaagctggtactattattagaaatggtggaactgtagcttttccaactgaaactgtatatggactaggtgcaaatgctttagatgaagaagctgtaaagaagattttcattgctaaaggtagacctcaagataatccgttaattgtacatgtttgttcaaaggatatatctgaattagttaaagaagtaccagaaatagcacaaagaatgattgataagttttggccagggcctttaacaattatattagaaaaaaatgatattatacctaacatgacaagtgcaaatcttaatacggttggaataagaatgccaagttctgaaattgctcttaaacttatcgaattatcaaaaagaccaattgctgctccttcagctaatatctctggtaggccaagtccaacagaagtcgaaagatgtgttgaggacctaagtggcaaggtcaattatataattggtggagaaagtagtgatataggagttgaatcaactataatagactgcactgtaaatccaccattagtattaagaccaggtggaatcacattagaaatgcttaaagaaatagattctaatattgaaattgatagtgctttaaaatcaaaaccaacggaagagtttaagccaaaagcaccaggaatgaagtataggcattatgcgcctaaagcccatttaaaaataattaaagggaaaaatgaaaaaactattgaaataatcaatgaaatattagagaattatatagaaaaaggtaaagacgtagctatattaactacagatgaaaatttaaataaatttaataaagggaaaataatatcattaggaagtgaaaataatttaagcgaaattgcaaaaaacctttttgagacattaagaaaatgtgatgacttaggagttcaacatatattatgtcagggctttgaagaaaaaggtgttggtcttgcaataatgaatagattaaataaagctgctggttatgatattttagaagtataaataaggaggatgggggagcctattcttctttttttataaataattaatgtaataaagttagttattacataataagtgataggaaggttggttttatgaaaattgcattaggttgtgaccatggtggattaaatttaaaagcagaaatagctaattatttaaagtctcaaaatattgagtttaaagactttggaacttatacagaagaatcttgtgattatgctgatatagcattaccagtagctgaagcagtagtagctaaagaatttgattttggtatattaatttgtggaactggaataggaataggaatcgcagcaaataaggtaccaggaataagagctgcactttgctctgatacattcagtgcacatgcaactagagagcataatgatgctaacatattaactatgggcgaaagagttgttggtaaaggattagcaatagacatagtaaaagcatttttaggggctgaatttgaaggcgatagacatgcaagaagaataaataaaattactgaaattgaaaaaaaatactctaaataataatgagtgacttaaataatatttaaaggttttactaggaggaagaagataatgagtaaagtaacagaaattaaacatccattgatattacataaattagcatatattagaagtaaggatacaggatcaaaatattttagagaattagtagaagaagtttctatgctaatggcatatgaagtaacaagagatttagaaactgaagaagtagaggtagaaacaccaatatgtaagacaaaatgccaaatgttagctggtaaaaagatggctatagttccaatattaagagccggtcttggaatggtagatggaatattaaatttaataccagcagctaaagttgggcatattggattatatagagatgaagaaacacttcaaccagtagaatatttctgtaaattaccacaagatatagcagagagagatataatagtagtagatccaatgttagcaactggtggttctgcagctgatgcaatctctttattgaagaaaagaggagctaaaaaaattagattaatgtgtttaatttcttctccagaaggtgttaaacttgttcaagaacaacatccagatgttgatatatatttagcttctattgatgaaaaattaaatgaaaaaggatatattgtaccaggacttggtgatgctggggatagacttttcggaactaaataataaaaagcgaagactaagtcttcgctttttaattaaattataaaaaagttagtttagttaataaattcagcagagctgaattaaaaaatatatcatttactaagaaactctactaggagtttctaccttaactattaattcaaaactattaactaaaaaagcagaggagtgaaaagtatggcaaaaagagaaggatacttatcgtgggatgattattttatgtctttagcgttattatcaggaaaaagaagtaaggatcctaatacacaagttggagcttgcattgtaaatagaaataatgtaattgaaagtatagggtataatggattacctaagggatgttctgatgatgaattcccatgggaaaaggaaggggaagcattggatacaaagtatccatttgttgttcatgcagagttaaatgcaatattaaatgcaaaaggtaaggaattgtctggttgtaaaatatatgttgcattatttccatgtaatgaatgtgcaaaagcaataatacaatcaggaataagtgaggttgtttatttaagtgataaatatgctgatactgattcggtaaaagcttctaaaagaatgtttaagtgtgctggagttgctttaaatcaactgatcccaactcatgagaaaatagaattatctctaaacataaaggatatttaaagagtttataaattaataacatattgaataaaataataattactcataaattaaattatatttatataaaaataaaaatacatacttttaaatagaaaaaatgcaatataaagagtttaaataaaataaaaaaagtgaaaatatagaacaaaaaactattgtgaataactgtaaaaagtaaaatgttttaaatattagttgatattggaaaatacaaagtggtataataatagtgttaattgtttaacaatttaaacaattaacactattatgattttagggtaatttaatgggaggattttttatgagagaagtagtaatagttagtgcagttagaactgccattggatcatttggtgggtcattaaaggatgttccagcagcagatttaggagcactagtaattaaagaggctgtaaatagagctggtgttaaaccagaattagttgaagaagtagtgatgggaaatgttatacaagctgctcaaggtcaaaatgttgctagacaagctgctgtaaaagcaggattaccagtagaagttccagctatgacaataaataaagtttgtggatcaggtttaagatgtgttgcattagcagctcaaatgattaaagcgggagattgtgatgtagtagttgctggaggaatggaaaatatgtctgcagcaccatatgctattccaggagcaagatggggccaaagaatgggcgatggaaaaatggtagatacaatgattaaagatgctttatgggatgcatttaatgattatcacatgggtgtaactgctgaaaacatagctaaagaatggggtttaacaagagaaatgcaagatgaattctcattaaattctcaattaaaggctgaaaaagcaattaaagagggtaaatttgtagatgaaatagttccagtagttattccacaaagaaaaggcgaaccaaaagtgtttgctcaagatgaattcccaagatttggatcagatattgaaaagatggctaaattaagaccatcatttattaaagatggtactgtaactgctgctaatgcatcagggattaatgatggtgcagctgcatttgtagttatgagtgctgaaaaagcagaagaattaggattaaaaccaatggctaaaatactttcttatggaagcaaagggttagatcctgcaataatgggatatggaccattccatgcgacaaagaaggcattagaagtcgctggattaactgtagaggatatggatttaattgaagcaaatgaagcatttgcagcacaaagcttagctgtagcgaaagatttaaatttcgatatggaaaaagtaaatgtaaatggaggtgcaatagcacttgggcatccagtaggtgcttcaggagcaagaatattagttacattacttcatgaaatggaaaaaagagatgcaaaaaaaggtttagcaactctttgcatcggtggaggaatgggaactgctttagtagttgaaagagtgtaatttatataaaaagaagaaaaaaggagctttttagaggctccttttttaattttagttattataaatagctttaatgataactattagaataaaaaataataaaattataaaaaataatgaataaaatgtaaaataattattcataaaaggttaaaaaaatatacaagatatattattgataattataaaatgataaaaaaacttaaaaaaaatttaaaaatattaataattttatcaaaaagtaacaaaatgaaattatgaaacgttatcaagaaaaaagaactataaaaaaggaatattatgaaaatttagacaattgaaaggtttggaaataatttgcaagaatgattaaaaaagtgtaaaaacgagattttggttgagtatttatggattattatctaataacaggcaattttaacgtgtgattgtaaaaaataactaaaaatgaggtttttattaatcggaaagtaggtatataattagctaatgtcagcagggatagaactaataacaaagtaatagtattcctatataagagcttatttgtataagcaaatataaatatataactatataatagttagtttttatataggaataaaatgagattctagttccccaataagttatttactaggagattaaaatggcaaaatatctaaggtttacagtaaaatctgtagcaaataatgatttgataactgcaactatttcatttttattattagtgttattagggaaatataaaattggattaattttgttgctaggagtaataatttctatgttgaattttattatttcagccaaaataacagatatgttcctaaataaccctaaaaaaaataaagcatttttatttccattaagttatctaatacgaataataactatagttgctatagcagtatttttctctaatagcttagttaatttattagtctttctaataggattttttatacattatataatcctagtaataactactataaaagtgcagaagggaagtgaatagatggaaccatcaaaagctatattttctttttacttaggcaaaatggccattgatataaagccagaatcaatagtgcagttagtaattgttttattaattttagctttagcgtggtggtctactagaaatatgaatataagaccatctaaaaagcaaactattgttgaatgtatttataacatgttaaataatgctgtagtgagtaatgttggagaaagctttataggtatagttcctttcgtaggaactctaggaatatttgtactagtaatgaattttacaggactagtaggaatatcaccaccaacaaaaaactttagtgttacattaactttagctttaatatcatttgtaatggtacaagcatatgccattaaaaagaatggtattggaggatactttaagggatatttagaaccagtatcttttatattaccaataacaatattggagagggtaatgcttccaatatctttatctttaagactttttggtaatatgttagcagctacttttataatagaacttgtttatgaaagtttagaaaagatagcgtggtttgcacaactaattataccaattccattacatttgtatttcgatatatttgatggtggtattcaagcaattatttttgtaatgttaacaatgataaacattaaaatagtatctgaacataattaaaaggaggaaattaaaaatgagtgaaataggaatgagagcattaggagcaggtattgcagtattagtaggattaggagcaggtattggtattggaaatgctacaggaaaggctgttgaaggagttgcaagaaatccagaagctacaggaaaaattacaacaacattagttatagggtcagcattcgcagaagcaactgctatttatggattattagtatcaatattattaatatttgtaggagtagcttaatattttaataactccagaagggggtaacaaataatggaatttaatccaggtattatattagccactatagtaaattttttgattctattttttggattaaaatatttcttttttgaaaaagttaaattaatagttgaagcaagagaaaacgagatagtggacaagttagataatgcagatatggaacttgaaaaagcaagaaatcttgctattagcaatgaaagagaacttcaaagggctaaggaagaaggaaaggctatcacagaaagtcataagaaaaaggctgaaaaagtatatgatgaaattgttgaggaagcaaaatctgaagcaaatttaattatagaaagagccaaagtagaaattgaaagggaaaaagaaaaagcagagtattctttaaagaaagaagcaatagacttagctttagaactttctaaaaaggtaattgaaaaaaatatcgatgaggaaaaaaataaaactttaattgatgagtttatttcagaggtaggtaaataaatatgtatgaatatttagaccgaagatatgcccttgcactatatgaagttgctgaaaaaaaaggaaaagttgatgaatatcttggggatttaagagaaatctgtaatctgatagataacaatactgattttttagaagtaattaaacatcctcaaataggtacaaaacaaaagaaaaggacttttattaatatatttaaaggtaaaattgatgaagaacttttgtcatttttattaatattaatagaaaaagatagaattttattcttaaaagaaaaattaaaagaaatggagaaaatccatttagaaaaattaaatgttttacaaggaattgttaagactacaatacctttagaagaatatgaatataatgctttagtaagaaaattagaaaagaagtacaataaagatattatattaaagaaaataatagatcctgagattctaggcggaatttatgtaagaataggaaatgacgttattgatggaactgtaagaacaagattagaagatttaaaaaagctaatgcttactacggaatagaggtgattgcatgaacataaaaccagaagaaataacatcgatcataaaaaaagaaatacaaagatatgaaaatcaaattaaaacttctgattctggaacaataattcaaattggtgatggaattgcaagagtttatggattagatgattgtatgcaaggtgaacttttagagttccctaataatgtatttggtatggctttaaacttagagcaggataatgtcggatgtgttttattaggttctgaagaaggaattaaagaaggcgacatagtaaaaagaactaatagaattgttgaagttcctgtaggagaaggtattttagggagagttgtaaatccccttggtgaagaaattgatggtaaaggtcctatcaattatgcaggaactaggccaatagaggtgccagctccaagtattatagatagagcttcagtaaatgaacctttacaaacaggaataaaggcaatcgattctatggttcctattggtaagggtcaaagggaacttatcattggtgatagacaaacaggaaaaactgctattgcagtagatacaattttaaatcaaaaaggtaaagatgtaatatgtatatatgtagctattgggcaaaagcaatcaacagttgcacatatagttaatacattagaagaaatgggagcacttgattattcgattgttgttgcaggaactgcatcagaaagtgcgccacttcaatatttagcaccatatgcagggtgtagtatgggtgaatatttcatgcataaaggtaaagatgttcttataatatatgatgatttatctaagcatgcagtagcctatagaacaatgtcattattacttagaagaccgccaggaagagaagcgtatccaggagatgtgttctatattcattcaagacttttagaaagagctgcaaagctatctaaagaaaatggtggaggttcattaacagcacttccaattatagaaacactagctggagacgttacagcatatattccaactaatgtaatatcgattacggatggtcaaatattcctagaaagtgaattattcaatactggacaaagaccagctgtaaatgcaggtatctcagtatcaagagttggtggtaatgctcaaattaaagctatgaagcaagtttcaggaacattaagattggaacttgcacaatatacagaacttgcagccttcgctcaatttggatctgatttagattctgattctaagagaagattagaaaaaggtaaaagaatattagaggtattaaagcaagatcaatataaaccaatggatgttgaaaagcaaatagttatattgtatgcaattgtaaatgactttttatcagatataaaggttaaggatattagaaaattcgaggctgaattcttagaatatatggatactcataatagagaggtcttaaagcaagttattgttgaaaaacaattaacaaatgaattaaaagaaaacattgaaaaatgtataattgattttaaaaaagaatttttaaaagatgcatagctttttatagctatgcaattctttaggaggtaaaacagtgggcgcagcgggacttatagaaattaaaagaagaatgaagtcagttgaaagtactagaaaaataactaaggctatggggcttgttgccacttcaaaacttaggaaggcaagaaaagagcttgcagataacgagaaatataataatttgtgtaaagaagttattagtgaagttgtttctagtatgccagaagattttgactcaatttattataaaagctttgatggagataaactctatattgtattaacttcagacactggattatgtgcaggttataataatactgtagccatatatttaaataatttagttcaaaaaagtggcggggcaaaggttgttgttgttggaagcaaaggaatttcatatatttctagatataaaataagcacatatgctgaatatgtggatttaccagatatgcctgctacgaaagacattaatagaatatataatgatgctatatatttatatgaaaagggagaggtttctgaagtaaatatagtatatacagaatttatttctcctgttaaacaagaggtaaaaagtgttaaaatattaccaatagaaaagaaagcttctcaagaaggacaatatataattgagccagatgaagaagccgtatttaaaaatgcaatagatatgtatttaaaaagccagcttaagacatgtatgcttagtgcaaaagctagtgaacatagtgctagaatgactgctatggatggtgctacagaaaatgcaaatgacatactacaaagtcttaatattaaatttaatagaattaggcaaggtattataacacaagagatttcagaaattgttgggggagccgaagctcaaaagtagcaaggaggaagaagtatggcagaaaataaaattggaaaagtagttcaagtaattggacctgtagtagatataaagttcgatgaagcttctttaccaaacatatacaatgaaattaaaattgatatgggtgatagagagcttgttgtagaagttgagcaacatgttggagatgatattgttagagcaatagcaatggaatctactgatggattgaagagaggtatgaaggctttagatacaggaaaaccaatatcagtgccagttggaaagaatgtattaggaagattatttaatgtattaggaactcctatagataataaaggagctatagaatcagatgaatcatatcctatacatagaccggcaccaagttttaaagaacaatctttagaaccagaaatgttcgaaacgggaattaaagttattgacttaattgcaccatatcaaaagggtggtaagatagggctatttggaggagctggagtaggaaaaacagtattaatccaagagttaattaataatattgctaaagaacatggtggaatttctgtatttacaggtgtaggagagagatctagagaaggtaacgatctgtatcatgaaatgatggattcaggcgttataaataagactgcattagtatttggtcaaatgaatgaatcaccaggtgctagaatgagagtctcattaactgggttaactatggctgaatactttagagatcaaggacaagacgtgttattatttatagataatatatttagatttacacaagcaggttcagaagtttctgcattattaggaagaataccttcagcagttggatatcaaccaacattagctactgagatgggtgctcttcaagaaagaattacttcaactaaaaatggatctataacatcagttcaagcggtatatgttccagctgatgacttaacagacccagctccagcaactacatttactcacttagatgctacaacagtattatcgagagctatttcatctttaggtatatttccagctgttgatccactagaatcttcttctagaattcttgatccaagaatagttggaaaagagcattatgaagttgcaactgaagttaaaaatatccttgaaagatatacagaattacaagatataattgcaattttaggtgttgatgaattatcagatgaagataaagctgtagttgcaagggcaagaagaatccaaagattcttatcacagccatttacagttgcagaacaatttacaggaatgcaaggaagatatgttcctgttaaggagactgtaagaggatttaaggaaattttatcaggaaaatatgatgatttacctgaatcagcattcttatttgcaggaactattgaagaagttgtagaaaaagcaaataaaatgaaataggagatgtaagttatgggaaaaacaataaaacttaacattgtatctcctgggcgtgaagtattaacagaggaaattattagtttattaacaacagagcctaatggtaaaattgaatttcttgcaaatcatgcagcgagtatagtagctgctataccaacagtaagtatttatactacagctaatggtgatgtgaagaaattatttacatcttcaggaattatatatgttaaagataacgtgattaatttctgctgtgattcatttaattatccagaagaaattgatataaatcgtgcggaagaggctcttaagagagcagaagaacgattaactagtaaaaaagaaaatgttgatatagaaagagcaaagagagcattagctagggcaaatgcaagattgcaatttaaataaggaaatcgctaaaaagcgacttccttattttttttatgaaaaattatttatataacctttttttttagatttgaatagaatgatatatatacacgaaatcagtagataaatatattaaatttagaataaagagaactattttaagaccttaataatatatatatattattaaaagaaattattttaaaggaatataaggggatatatttatgtaaccctaagtaactaaatatatggttaagaatttcatttagacaattagtattgcagcgatgtataaaaaaaatagtttggacaataattttagaggaagggcaggggattacaatatgaaaaaggtgttttttgtatttcttttaatcttttctctattaattatttgtggaaaagaatataagtgtgaatcaaaagaggattctttcagcaagattgaaggatatgtgatgaataattatgattttgtccaaaatggaattaagttagaatatacagttgatgaaacattaaggaatgaatatttaaggataaaacaattttttgaggaaaacaattttttgttactttctacagataaaaataatattacagcagaaagtgaaaatattgattatagtattagtatttgtgaatataatggtttgataaaagttcaggttattctaattaataatgatgttagtaaatcagagaaagaattgaaaaaattatcacagaaaataagaagtgataattttataaatgaaaggtatttttcatttataaagggaaagataaatacacaggataaaaatttaattggtgatttggaaaaaaatttaaatataaaggttaatgaatatttagatataaataatgggtgtgttgctgaagctacatttgaagataatcaacatataaacattggacaaattaagtacgatacaggttcatatttaattataggaacaccgataattttcgtaacatactaacaataaatatggaggataatatggaaaaaatcatagttagaggtggaagggaacttcatggagaagttgatataagtgttgcaaaaaattcagtattacctataatagttgcaactattttaaatccaaccgaaataattttaaaaaaagtacctatgttagaagatgttactgtcttgattaatttattaagagagttaaattgtgaagtgcaattttcttcaataacaggggatttaaaaataaatactcaaaatttaaaagaagtagatccaaatagtgaattaattagaaaaatgagagcatcttttttaattatgggacctatgttagcaaggtttggcaaatgtaaaatatcaatgcctggaggctgtaatatcggaagcagacctgtagatttacatttaaaaggttttaatgctttaggaatagagtcagaagttggctatggttatgtagaagctaaaattgataaattgcatggaagtagaatttatttagactttccatctgtaggagctacagagaacattatgatggcagctgttttagcaccaggagttactgtaatagaaaatgctgctgaagaaccagaaatttgggatttagcaagatttttaaattgtatgggtgctaagattgaaggagctggatatggaaagataactatacatggtgtatcagaattgaaacaaccaaaaccatttacacctatatttgatagaatagaagctggcacttttatggttgcagctggaattactaatagtaagataacaattaatggagtaaatgaagagcatttaatgccaacaatcgaaaaattaaaagaatgtggggtttactgcactgtagacggacaaaagatgattgtggatggaactagagaaaaaaggccagtagatataaaaacaatgccttatccaggttttcctacagatatgcaagctcaaatgatggctttattatcaattactaaaggcgtaagtgtaataactgaaactgtatttgaaaataggtttatgcacgttggagagcttgggagaatgggcgccaatataaaaattgatggtagaatagctatagtagaaggtgtaactactcttactggatgtgaagttaaagctactgatttaagagctggagcagcaatgatattagcaggattagttgcaaatggacaaacggagataggagaaatatatcatattgataggggatatactaatattgaggaaaagtttagacaacttggagcggaagtatatagagtttataaataaaagtaggagccttttggggttcctaatttttttgtgtagaaatataagattaataatgaaaattgtatggaattgtttaacagattaaaacatatatatagatgtaacttgataagatggagggattatgagtaaaagaattttaaaaggattcacaaccattaagttagtaatagtaacagctatatgtattattttatttatgatagtaattccagtaataactatgaaagcagatgtgaaaatagattttaataaatatgcagctaatgaagaaaagatgaatgttaatgaatcgaataatactgaaaatattaaagtagaagaagaggtagataatatagagattgaagataaagtagatgaaatagaaaaagtagatgaaggtaacaatacagataatgtggataatatagagaatacaaacaatgaaataaacattaatataaatagtactgtttctttatatattactttagagaatagaatagaggagatagaactagaagagtatgtatgtggtgtacttgcaaatgcaatgcctattagctttgaacctgaagcgttgaaggctcaagctattgtagttagaagttatgttgttagtaaaaaattaaatccctgtatagaggctaatggtggagatatatgtgactcagcacattgtcaggtttattcatcaaaggatgatattattaaaaaatggggagaggaaaatggagagagatactgggaaaaaataaaaaatgcggtaggtgatacaaaaggtaaggttttaacttatgatggtgaattggcaatgtatccattatatttttctgttagttctgggaagactgagtcagcagaagaattagggcttggaaaaattccgtatcttaaatcagtagatagtcctggtgatgaggaatcatctaaatttgaaagttctaaggaagttacattaagtgatttagcctatataataagtaataaatatcctaagtctggcgtaacttcaagtaatataagagatagtattagtatattatcaaggagtaaggctggaggagttattgaattaaaagtaggagatagtgtgattaagggatctgattttaaggttttactagggctgaactcaataaactttgattattccataggcgataatacgattgtatttgattgtaaaggccatggtgaaggggttggaatgagtcagtggggagcaaatgttatggctaaagacggtaagagttatgatgaaatattaaaacattattatacaggaattaatataggagatttaaaatttaatttataattttagtgtatactatataaacagtgagagatttgatttatcaaatctctttttgtttttttatatataaatttggcgaataaaaaattggtatagattgaattaatttggttttaagggcaagaatacaatacaggaggtgttgaaatggaccaaaataaaaaaaataaagtaaaggactttttcagaaaggagggcttttacttagttttactagtatgtttatgcgtagttgcaactgtagcagcatttactattaaaaagaattcagttgctaaggagcaaaataatactagcaatgaattatctttaaatgatgttcaagatagcagttcttcagatgttgattctaactttaatatgcaaaatgcagaaagagtggaaagcaatgatgaattagcggaagcaaatgataatgaaatatctcaagaggaagttactaatgaagtggctaatgatactaacgaagtagctactgatgacgaagcaacagtttcagaaaatcaaaataactcagagcaagaagctgacgttgatgtttcagcaggaactgatagtaatattgttttatcattacctatagacggtgaggtagctatctcaagagaatttggaaaaatggtaagaacttattcagatgaagctagaagtgaagatacatctagaagaggtattgatataaatgctgctgttggaacatctgttaaagcagctgcagaaggtaaagttgaagaagtatcaagtaatactacagatggaacttatgttgttattgcacatgctaatgggctaaaaacaaaatatactaacttaagtgaagatgttaaggtagcagcaggggatactgttagtgctggtactgaaataggtacagtaggaaatagttcaggtatatttacatcaaaaatttgcggagatgtattaaatattcaagtacaagatgcaaacggaaaagatgttgatccaagtgcttattttgaagtcaaataatttattaaagtatcaaccatttttatggttgatacttatataattatttaattggttagagagtatgaattttttttatagattaagtaaataatatatgaaaaatagagattaaggaggtataatcttgaaagactatatagaagaaagagttttagaggtagcccagtatataattgattcaaaagctacaattagaaaaacagcgaaagtatttggagtaagtaagagtactattcataaggatatgacagaaagattacctaaaattaatccggctatagctgaacaaacacatttaatattagaattaaataagtctgaaagacacattagaggtgggaaggctacaaaaatgaaatataaggcaaatgagctataaatttattgaatgataaattcattgcatatataatataaaaaggaataattttgtagaaaaaacaaatattttgaattttattatataggagtgaataaaatgtggttttggagaagtggtaatgatttgggtattgatttagggacagccactgtacttgtttatgtaaagggaaaaggaatactattaaaagaaccatcagttgtagcaattaataagaataataataaagttttagcagttggagaggaagcaagaagaatgatagggagaaccccaggtaatattgtagcagtaaggccactaagagatggtgtaatttctaattatgatattactgaaaaaatgcttaaggcttttataaaaaaggctttaggaaaaagaagggttatagcaccgagagttatgatttgtattccatcagaagcaacggaagttgaaaaaagggctgtaatagatgcagctatgaattcaggagctaagaaagttaatctaattgaagaaccattagcagctgcaattggagcaggattagacattactaaaccagatggtcatatgattgttgacattggtggtggaacaactgatattgcagttatttcattaggtggaattgttattagagagtctataaaagttgcaggtgataaatttgatgaagcaattactagatatgtaagaatgaagtataagcttctaattggtgaaaagacttcagaagatttaaaagttagcgttgggtctgtatttaaaggttcaagaaacatatcaacaactatgaaaggtagaaatttaattactgggttacctgatgaagttattatttctactgaagagttaagagaagcattaatggaaccagtattaatgattgttgaaagtgtaaaatctgtattggaaaagactccgccagaattagcagcagatattattgaaaaaggaatattaatgactggtggtggttcattaatagatgggttagataaacttatagaggaaaatacaggtattaatgttagtattgcaagtaacacagtggaagcagtagcaatgggaacaggtgaggttcttaattatgctgataaaatggacaataatatttctaatagagaaattactttaatagattaaatttatattaatgaacaaataatgctagaagttataacttctagcattatttgttcattatagaatttaaataacaagcatgaattaatccatgggaaattacttttgccatttcgaaaacaaggtgaagtcttatacttctagaagtgaagaattcagcggtatcactggagtctattataccaattattgaagcaatacctacatctggaagagattttccaacgccttttccaggatgaataggataatcacgagtgtgtatttcaccaattgaatttacatctccgaggcatgcatctatacctattatagaggcattaggatgcagtttgttaatttcaataagctttttatctaagtttaatgcatgaattggattttccaacgtaccgtatacaggtaaaggaaaattatgttcttgaagaaaagttccaacaagtggacctaaacaatcgcctacgcatttatcagtaccgatacatactataatactattagaattaatatattttctcataaattcagcaatttcatagtatgctaaattagatttataattaaactttcttttaatcaaataattcacccctatctttatatatggaaattatttttagctatttaaaataacgaaagataatgcttgctattttaaggaaaacttttttatatttgtttagtaaataaacttaaataataaagtttgagctttaaattttaattacatgaagcttgtcttatataaaatatatgatttataaagcaataatataattttattataaaaaattatattaagaactttaaaatataaagtctatgatttgtgcaattataatttataaaagtatgtaaatcttaatatacagtaagaatgttaatagccttgtacttatactatatttataggatggtaaatttgttactaattatgggatgaaaaatgaataaaaaatatactattaaatttaaataaatattattataaaaaaataaaattatatattaaagcaaagaaaaatagagaaaagtagagaaaatagagaataattatgtataaacaggaaaaatgggggttgaaatataattggtttaattatatactagtccttgtcagttcggcagtaacataatgaatgacaaaaaagttgtaaataaacatatgggggagttcccgagaggccaaagggggcagactgtaaatctgttacgtttcgtttcgatggttcgaatccgtcctcccccaccattaacaactttaaaaaataataaatttgaaatttggtattatgcttcattggctcaatggcagagcagctgacttgtaatcagcaggttgttggttttaaaatttggagacttacttaggaaactcactcctcacatgcgttcggaggagtaagttcgagcaaccaaattaaaatttgggctcttacttataactaaactcaaagtttttttctatattaaagaaatcagcataatctatatcaaataaactctttgtaacttttgatacatctatatcttccttaataagctgagttaaaactccagcataagaaaggtctccttgaattattgcaccatagatttttccatctttatggattatctttttatagttattatcttcaactttagtttcaactatataagtttcatcagctggttctaccataccaagagacattgtagctatacctacaaagttcattgtatttttacttccaaagaaatcagtcattatcatttcttttcctaacatattatgtgctgctattataccttctttaacagctgttggccatattggatttcttcccgttacatctccagctccatatatattttctatattagtttgcccttttgcatcaattattaatccaaatttatcacattcaacattactattttccataaatgcaacattagatctaacacctgtagcaactattactaattcacatggaacttcttcaccagtatttaatactaaagcttttggattgttattttcatctaaaagtaacttttcagctttaacatctaactttaaagaaacaccttcttcaatgaatttcttttcatatacatctgaagcatgcttgtctaattgtaatggaagtatcttattactcatttcaactaaagagatatttaatccttgtccaagtaatccactaactgcatctattccaacaagtccagcacctaaaactactacattcttaatttttttagcttgttcttttattaatatagcatcatctaagtttcttagtccaactacattattaccttctctaagtcctggtactggaggtataaatgcagatgctccactacagactaataatttatcataacttaaagtctcaccatttgatagttctaaagtttgttctttatcatttaatgctttaacttctaaacctttcatccaagtaatattgttttcttcaaagaactctttacctgtaaagtttaaagcatctacatctctatgatttgaaatgtaatgatgaagtatgcatcttgaatatacattttcatctttagatattaatactatttcagcatttttatctaattctcttaaagttttagctccacttatacctgctgcagaggctcctataactacatatctcattattcagttacctcctctaaagtaattgctcccataggacatttagctacacattgtgctgttccatgttgcttacatgcatcacatttcattatttctttatgcattctgctatcagcttttaatactccataaggacatgccattatacacatgtaacaactagcacagtgatctttattatattccactaatccagtttctttattcttactcatagcgcctgtcatacaagtataaacacattctggtctatcacaatgtctacagaatattggggcatatttacctttactatctattgttattctacttcttgtatcctctgactcgtgagctacaatacatgctgttgtacaagttaaacagccaacacatttatctctatctatcttaattcttttcatctttagtcaccctctattttttaatgatatttactgcaactgttttaaatgatggttcctttgaatatggatcataaactgaaggagtaagtgcatttgtttcaatatagtgaattggtgcatataaatgatccttcttcacatgatcagatatctttatagtaaagtctttagttactccattttgagaagctattgaaactctttcattttcttctatatttaattcttttgctaactctggatgcataaatgcatatgattccttagagtaaattctttctgactcagcaatttctcttgatctaacttgagtatgccattgccctactgttcctcttcctgagttaaatatatatgggaattctgcacttgtttgtgttgggttttctgctatatcttcaaaatggaatttagccttctttgatggagtatagtaattaccatcttcatataatcttctttcatcttccactaaagtttctccagctctaaatggccattgaactcctcttgaaccttccatatttggtccttctaacatttcataagttacacctgtaatatcacaaggcattcccttagaacatttctttaataattcaaatgtagatcttggagtttcccatccttttaataaatctcccattccaagttccttaccaatgttatagaagatttcgaaatctgataattccccttcttctttttcaattacaggattaaccttttataatcttctttcagtatttattaatacaccttcttttttaattgctggaacagaaggtaagtataaatcacaaagcttagcactatcagtatcttcatatatatcttgaactactaagaaatctaaatttttaacgcacttttcaaattcttcattatttgcccatgaatgtcttgggtttgtacaaattacccataaccccttaatttcccctgcaattgctttttcaattattgcattgtaaggaattgttggttttgtagcaagtacactttcatctacacctaaagcttcagcaactgcttttctacgtactggattatcgaaatctccaccaccataaagtcctgccgtattactaaatgctcttgaacccatagcattacattgtccagttaaagagtttgcacctgtacctggtctacccatgtttcctgttattaatgctaaattaattatagattgagctgttctaactgcttggtaaccttggttaactcccattgtccaccagaatgaaactctttctcctgcatgaataatttcagctaattctaaaactctttccgcacttattcctgtttcagcttcaactttatctaaagtaaatttagctacatgattcttgaaatcttcatatccttctgtatgattctctatgtaatcaacatcaatatatcctttttctattaaaacattagctaaagtatacattaatactaagtcagcctttggtttaatatctatccatatatcagaattcatagctgtttctgattttcttggatctattgttattattttagcttctttattttctctaattcttccccagaatactggatgagctataactggatttgctccaattaaaattattgtatctgaaagttctgcatcatttaatgtatatggtggagcatcaaatccaaaactttgtttatgagcaactactgatgtagccatacataatcttgtattaccatcaccattaatacccatataatttcttcctacatgccctaataaagccatatcttctgttggcatttgtcctgtactaatgaaagcaacactttctttaccgtatttttcttgaatgcttgtcatttttttagcaaatgttttaaagccttcttcccatgaaatttctttcatttctccattttcatctcttaaaagtgggctttttcttgctttaatttttgtttgttgcttatctaagtttaatccttttatacaacaaaaacctttatttacagggtaatcaacagtaggagaaaccttagctatcttaccattttctacataaaaatctacattacatgctaatgcacataaattacatgttgattgaatcttcttcatattactcccatctccaattcatgattttaataaactctatattcagtattatttcagattcattttatcactaaaggttatatgcaactgtgactataatcacaaattgtacgttttattgtcatttatttaacaatattattagtaaaatctctttttttatttaataaaagtaaaaataagctattagatttttcaaaaataacctaatagcttatttaaaatattatactaattcaatttgactaataaaatattcatcgtcatttttatttgatatcttttcaattccaaatccagttattccattaagttaatgcaaatttaactatttactatttctccaccgtttatgtgaatagtttgaccagtaatatacgatgctgcctctgaagctagaaatacatatgcacctgcacattcaacaggttgcccagccctccccataggagtattagatccaaattgaggaatttctcctttttcaaaacttgatggaataagcggtgtccatataggtcctggagctactgcatttactcttataccacttttattctttgctaatgatgttgataaagatcttgttaatgttacaattgcccccttagtcattgaataatctataagcttttcatttccggcaaaagctgtaactgaagatgtatttataatacatgcacctgatttcatatgctttaatgcttcccttgacatataaaaagttccataaatattagttttcatagttttatcaaattgatcatctgaaatttgtttgaaatctttacattcatattgaactgctgcattatttactaatatatctattttcccatattcattaattactttttctactacagaagtacaaaaagctacatctgaaatatctcctgaataaatactacatttccttcctgtagcttctattaaatttttagtatcttcagcatctttcttttcattgtaataaactatagtaatatcagctccttgatatgcataagcaatagctaccgctctccctattccactatccccaccagttattattgcaactttatcttttagtagatctccactttttatatacttttcatcatagtatataggtaatggattcatttcacattcaaaccccgggtgaatattttgatgttgtgccggaaaatttgttggaaagttcatataatcactcctttaaaaatcattgtcatactttattattagttactttccaacttataattcttttttataaaaatcttatatattaatttcattttataaaaaaaagaaattgccaaagcaatttcctttaatttcatccctatattaatggaatactttatcatatactattgaatctttaaatccaaatgtcatttttccatttttctcaaaaacttcacttacatacaacttaccatgttctattctttcttttaatgtaaaaatagtactatttcctaaatcacttatactttctccataaaaagatccatttttctctttataaatcatagggttaaaattttcagatttaactaaactagtataatccataattagagaaacattgtcacttctaaattcttctttagatattccttctggtaattcataagaagttaatgtcacattattttctttatctaacgtaaataaaaataaatgtggtaatatattcttacctctttcagtttcataataactttcttctattacaaaatacccctgaaaattttggggcaaatttctaattttgtgattacataccgcatttatatgcttagctttaggatgtataatctttcctttatcttcttcaccttttatttgtgcctcgttattaaatttaccacacaaatttttgataaaagattctaatctactcatatctcctccctaaactgtttatttttttaataattcatcaacaacagctttagcttcggctaagcaagaaccgcatccttttccacaattagttgcactttgaaccttttcaaaagtatctgctccattttctattgctctttcaatatcttcaacagaaacattaaaacaataacaaatttttttagctttatccatatatattcctccataatattgctatttatgcatataactatagttatatgtatatttatagttttaacatacatgaaatctttatactcacttattaatttactcataaaaaagcttgttattattctttatttattaactacgttaataattaattatttgcataatattgaatcaattattcttcttgctattgttgttttatctggtaatataggaaggttatctttgctataccagtctgcatgaagtatttcatctccatcaaccttaatttctccactttcatattcagcagtaaatccaatcattatagaattaggatatggccaaggttgactatcaaaatacttaatattttttacttttatattaacctcttctaatatttcacgttttacacactcttctaatgtttcatttacatctacaaatcctgcaatagtactatgtaatccatcaggaaagtttttgttatttgctaataatattttatcccccttagtaatccctactataattgcagggcaaaccttaggatagcatgtatatccacaactcttacacttcattgcaaattcattattagcaaactcattttttccaccacatattccacaatatttatttgtcttatgaaaatgaattatctgagcagcctttccagctactgatatactttccttatcaataattgcagcactttcccttaatgtaataaactttaattctccagataccttcactgcagaattaatttcaccacaaaaacactgtgtatcttttagctttccaagatgatactttatttctaatccatctattaatttctttatatctttaaatgtaggaatgctagtctttcccatatcctctttaactaaaatcattttatcttgaaataaaaaccataaatcctcctctttatttccttcttgaaataagggatttgatacaaatttcatataatcatcagtgttaatcatatttcctccaatcttattcttctactatttcacaatgcatatatttctcagcctcatcccaaggcacaataaatccttgacccttagagcaaaatactgagtttgaagaatactctatatctgcatttttattatatcctatttttcccataacctcatcagtattatgacatatatcatatccatcaaatattaagcttatattaccttttcccttagtgaaagcaataagctccatgccataatccataaatgttgctactggtcctcttcccgttaccctgactttatttaaattagtttcaggtgcattaaattcaccacttaatttttgtatatctgataaaactcttcccatataatctaattctacatctattgtaaatctataaaatggttctaataataaattttcagccttttctaatccttgtcttaacgccctatatgttgcctctctaaaatctccaccttctgtatgtttattatgggctcttccagttaaaagtgtaactttaatatctgtaatatcggaacctgttaataatccatgatgatttctttcaaagatatgagttttaattaaattttgctgtcctgttgttaagtcatcagcatgacacttattttcgaatataataccagtcccccttggctgggcttcaagttttaaatgtacttctgcataatgctttaatggttcaaaatggccataaccttttactatatttcttatagtttctttgtacattatttcacaaggtccaaaatctacttttaaattaaatctttcatttacaatttcttttaaaacttctaattgtatcttacccataatatgcacttgaatttccttatgtgtctcattccacaacacatttaatgcagggtcttcagcttctaatattttaaaatactttaaaacttctttttcattataagattcatcatatataactttagacattaaagttggaatcatattaaactttatatcattattaaaaatacctattccatctcctgcatttacttctgataaacctgttactgcaaaaatatcccctgcttcaacttcatttacatttataaacttatttccattataaattctaatactacttatcttttcttttacatttgtattttctttagaaatttctatttcatcccttacttttagtttgccacttaatgctttaataaatgtaattctagttccattactatcatagcgtattttgtttactacacctgaaaattcatcacttgaatcataattagtaaatgttaacttatctaatacatttaaaaattcatttactccttcatcttgaagagcagatccactaaaacatggatatattttattttcttttattaaatcccttaatttatttacccataattttttttcatattcatcatttaaatatttttctaaaagaagttcatctttttcagctataaattctattgtttcttcatccatatcttctaagtttcttataaagcaaacatcattagaaagatttttatttatttcttgtaatactctttctaattcagcaccagttctatctaatttatttataaagaaaagtgtaggaaccttatacttgcttagcaaattccaaactgtttcagtatgcccttgtaccccttcaactgcacttactataataattgcataatccattattcttatagctctttccatttcacaagaaaaatctatatgtcctggtgtatctattaaataatatgttgagtcagctatctcaaagactgcttgatctgaaaatactgtaatccctctctttttttctatatcatgactatctaaaaaagaatttttatgatctactcttcctcttgtttttatactttttgtatgataaagaacttgctctgaaaatgtagtttttccagcatctacatgagctagtactcctattgttttcctcatataatctcctttgctaattatgtgaaaatttatatttataattatatcatcttaagtattttttgctattttaaatgtattttaattataaaaaagcacattaaaagcaattttaattacctctaatgtgcataattcaccttattaaatatatgattctgatatctttacaaaatatttttgtgttaaatataacaactgacaagtggttttaattgtaaaataaacatcattcaaacaatcttcttctaaatcaagatattcttttctattaatttttaattcatctaaataatctcttgattcgttaatattatttaatattttattaaaattttcatcattttcctttaatgctttttttaatgttctgtgcaataataattcatatacgaaatgatctttcatatcctttccgtaatattcttctaaatgatatttacaaaagcaatctgctatatagtgagcaattctacctacaataaaagatacttcattaatatcaaggtcattattttcaatgtattttttatattcaagcatcttgtcttttgaaacactatatgtgtgtttaatcttattttttcttttgtgtaggtctggttctatacatccaagtaagaatctctttttatctaaatttaaattatatttttcgttacaaattttataacaatatgagccaatggctaaatgtgtgtttattaacataagagttctccccctatcaggaattaatattatatataatcccgataatattattatacatcataaatccaaattgtgattgtaaattttttgtttttattctggctgccatgtaatattttataagtctcaaccaatattatctatgtaaataaatattacatttaaatatttatgattaatttcttaacatatgactattttattttgcacataataaataaaaattattaattaccttaattattggaggctaattatgaaaattagattaggatatgttgcaatttcaaagaaattaggaaaaaaggttacttcttctagtaccgtaacattttcaaattataacaaaattattcttccatcaaaaaaattagaaaaattacaaaccgttgctgcatcaaacttacatgatttagaaaaaataataaaatataatattgaaaacaacattcacttttatagaattacatcagcactaatcccattagtaactcatcctgaagttggatattggggccatagagaatttttaaagcaggattttgaatatgtaggaaagcttataaatgaatctaatatgaggatcgatacacatcctgatgaatttaatgtaataaatagtattaatcccaaagtagtggaaaatactaaaataaacttgcttcgtcaagcagaatggtttgaagattttaaatatgatctcggtaaaatggtaatgcatattggaggggcaacaaatggaaaagaagcaggtttagaacgttttattactaattttgctaccttccccaaagaagttaaatcaaagataattattgaaaatgacgataaaacatatacagcacgcgaaaccttaaatttgtgtaatgaattaaatttacctatggttttagatattcatcatcataattgtaataatgataatgataatatatatgacttaattcctaaaatatttgctacttggaaaaatgaaaagcttccccctaaacttcacttttcttctcctaaaaatggagaaaatgatagaaaacatgctgattatattaatcctaatgattttattaattttctagaaaatataaaggaatttaatactgatattgatattatgcttgaatgtaaagaaaaagatttagcgctttttaaacttgccagtgatataaaggatttaaaacctgaatacaaatgggtcgatgaaagtacttttcttgtataaatatatgaaaaatggtatataataaaatatggtgtaaaacatactgcaatatattttacaccatacaactttagttaattcgacatatagcatttaaaaatttagtagcaaccccttaatggattagctactatttcttatttttaggacaaaccttatattatataaaagctctcctttatttttccgagcaagttcactacataaatataatcctaatcccgaactacttacttcttttgataagtcttcaaaagtgttatatttaataaaaggttctaatagcttttctcttatattttccgggaaattagtacattcattacttattgtaaaaactatattttttcatccttatataaatcaatatttatagtttccccaatactgtattttaaagcgttatcaattaagtttacagcaatagattcaatatcttctagtactgaattatattgatatttcttgactggagtttctactccatcaaatgatttaactccctaaacactctttatcttatcctctaatacaacactttctttaccccctatcatacttaaatataaaaccgctactaatattatatttattgattttttcataaaacaaaacctaatatattattcaattatataatacataggaatttttacatagtaatacttaattgttacaaagttcttaactatttttctaatgctttttctacctcatcataatatcttaatgtttcatcattgctcttactattaaagaaaatatatctaccatcttttaacttaatgctaatacaattaggattttcaaagtaaagatataatttacactttccataaccatctatactaaaattaccaagattatatgttgatgcccctaccccatttgttcttattcctgaaggtagcttatctatcattgttacctcttcaatatcatcaacactaacctctattccataagttggtgcctttatttttacaacattatcacttacatttaaagtaaaagtagcatggtccattacaactaaatttcctactatacctactataagtattccagcaaatattaaacttccataataaattcgtcttccctttttagtacctaaattataagttatcccatagcctgtcctatcttcaaccgttacacttctatcattaggattattatatacacctttgctccaaaactcatcattatcagtataaataggatttgtacaagtatttattatttttccttgttcttcttttattttattatttatataaaatatgccaaaaagaataatgcttgaaggtattattactgataaaagaaataatatcatactattgttattatttaagaaaagtgaaaacataaataacataccaatactttggattgtagcagctattatagttcccatcgtccatgttcttttaaatactgtattatatgctatattagcatttgtatcttcacttataacttctgttttccccttagaatatattttgtacataactaagaaaattatattacctattaatgcattactagctgcaattccaagtgaaactccatactcttttatattattaaacacaattattattggaaataatgagattataaaacttggaataaaccaaagaacagatactggcattttatcttttaaacgagtaacttccgtgtctatagttactaatcttttacttggtaataaccaattattttctcgttttaaatccattaaccttttattatatttaataaataaacttctagtaaaaatatatactccaattaaccataaaaaaaagtataatatttgatttgaattatacttaaagaaaaaagatggactaaataaaatagctgcaataataaaacctattatatttactttcttaaactcttttactatatctaatactttttcatttttaagttctaaaaatggaatagttactccaattaaaatatttttatctcccttgatcatatatttacaattaaaatacattgataacaaaacaactacaggtatactcgcccaaataacattaaaaatccccatctttacccctcattccatacgatatttaagccattcatatttttgtaaatatcttcacacattttcataaattctttatattcaattccctttatacctgattcagcaattataagttctagttcctcttctaacttttccttaaattctttgcttacatctaatgatggactaaccttagctccatgacgtctatctatctctatatatccttcattttttaatattgtatatgccttattaacagtcatattattaacacctatatcttccgccatttgcctaacggttggtagaccttcacctttttttaattctcctcttccaattcccagtacaatttcatttcttaattgtacataaataggaatattgctagtcatatctaatttaataatcataatttttcctctttgtatagtttgtattattaattgtaatacaaactatacaaataaacaatattaaattaaaaaaatttatctgatgactaactgttataacactcgctctaacaatgggcacccccatatataacatattcttagcttctaaataaaaaaagcaacattaattaagttataaaacaaattaatgttgcttaaaaattatttttttaatactaatcctttacttctgatacatgtacactctcttgcttcttcagtatgtaaacattgatactttatttttttaggagcctctatctcaacttgttttttttcttttaaatcctttttattcatttctcttctccttttctctataattcaaattctaaattttaatttaggtaattgaacttaccctacgaataaatgtaagtagcgagttttctttatataaataattatttactaatttattttttattatataataattactatctattaatatttattatataatacttcttttaataagtacatataatataattagcaaaaaacaaatgataagtttaattggtttaatagtttcattatctctaattatgtatttagcatataagggatattcaacaattataactgctcccattatagggttattaactattttaatttctattggtcttaatggtcatttaatggctaattatactgaagtttatatgagtggatttgctggatttgtaaaaagctattttccactatttttaacaggtgcaatttttgcaaagttaatggatgaagctggatatggtagatctattgcagcatttataacaagtaaattgggtaaagataaagcaatccttgcaattgttttatctggtgcttttttaacttatggcggagtatctctttttgttgttgcatttattttatatcctctagcaaatattttatttaaggaagctgatattcctaaaaggcttataccaggaaccatagcactaggggcattcacctttacaatgactgctatgcctggttcacctgaaatacaaaatgtaattcctatgagttattttggaacagatacttttgcagcacctctccttggaataatagcaagtataataatgtttactttaggtatgctatggcttacaagaagagttaaaaaagcaaaaatcaacggtgaaggatatggtaattatactgatactcacaaaattgattcaaatgaaaacttacctaatattattttatcaacacttcccatattaattatattcataactaattttactttatctaaattttattttcctaatactgatggaagttatttagataaatatggtgttactttagataaggtatgtggtacatggagtgtaataatttcaattgttatagcaattatatatatcattttacttaattttaagaaatttaaaaatttaaatacttctcttaatgaaggagtaaagaattcatttttaccgttacttaactcaagtgcaatagttggatacggcagtataataaaagcattaccaattttcacaacaattcaaactagtataatgaatatttcttctaatccaattatttctgaagcaatatcagtaaatgtaatttgtggacttactgcttctgcttctggtggattaggtataagtttatctgctcttgcaccaacatttatagaaatgagtcaaaatttatcaatttccccggaaatattacacagaatagcatctttatcttctggagggttagatactctacctcataatggtgctgttataaccacacttgcaatttgtggcttaacacataagcaaagttataaggatatatttgttacttcagttgtcattccaatattaacaactgtaataatagttatattagtatttctaatatttatatagtataaaagaactcaagaatactcttgagttcttttatactaatgatattttttatcccttaacagctcctgctgcaataccttcaattatgtgtttttgacatgttaagtagaaaattataattggtataattgcaagtactagtatagccatcattgctcccatatcaacagcaccataaccaccacgtaaatattgtactgctattggaatagtcttatattctgttcctaacaataaatatggcaataagtagtcattccatatccacattacatttaatatagctattgtaattgcgataggttttaatagtggtaaaacaattaaaaagaatgtttttaccggcgagcatccatcaatcattgcggcttcttctatatctattggaattgatttaacaaatccactgaacataaagacggataaccctgatccaaatcctaaatatattattattataccaagaggattatctaagcttaacatatttgctactttactcattggaaacataaccatttggaaaggcactatcatagataatacaaataaataatataaacaacttgtaaattttgattttactcttgtaatataccaagctgtcattgatgtaaataatataattacaactgttgatccaacagttataaataaagaatatccaaaagctgaaataaagccagtcttatctataccattaacatagttcgcaagccctgaaaaagttgttgaatttggtaaagcaaatggcgatctactaatatataatttacccttaaatgaattatataaaactatgaagatcggtgctaaaaatacaatagagaatataattaatattaaatataaaagtacattgttctttttcttaggttcatactttaaattaagttttgtatcattttttaatttagcttccattaattttcaacctccttctttctagttatacttaattgaagtaacattattactgctacaattaagaagaagattactgctttagcttgaccaacaccttcccatcctactcttccatagaatgtcttataaatatctaatgcaagcattgctgttttattacctggtgcaccatcagtcaatgctaagttttggtcaaacaatttaaatgcatttgacattgttaagaaaagacaaatagtaattgatggcataactagcggtatagttatctttcttaatgtcatccatttagaagcaccatcaattttagcactttccataagttcacctggtatgttttgtatacctgcaatatatattatcatcatgtatcctatttgttgccaatttagtaagataactaatccccaaaatccatacttaggatccatggttaaatttacaccaaaataatttaatattccattaataataattaaccatatataacctaaaactataccacctataagattaggcataaagaaaacagttctaaatatattagttccttttaattttctagttaaaagatatgcaagtgcaaaagcacatacatttacagttataactgatacaacaacaaatttagttgtaaaaattaatgcattcataaattctggtgtagaaaatacttttttatagttatctaatcctacaaatgttgcattagtaacagtagtaaatttagtaaatgataagtaaatccccattataaatggaactaaaaaagctataccaaaagctactaatgtaggtaatgcgaataaccagaaatacttctttaaccctttttgcatagtctcatccccctttaatttttgtacttaatatcctattactctttaataaaggcagcacatattatatgctgccttatttaaaaattactgagctttttcagctttccaagaatccttaacggtattaactacataatcccaatcttgagtaccttgtacatattctaataaagcacctgcaaatgtatctttaaagttttggcttgggaatgcttggaatatccaaggaacagtatttagagtatctttactcatccaatttaaaacttccttagataatggatctgctggcttttcatcatcatcaaatgtatcaaatggagctataaatcctaaatctcctgaaacataagcttttccagtatcacttgtaaataaccaatttataaaatcaattgatgcttgttgcttttcttctgaaacttgactatttattgctaaatagttttcagtaccaatacaaagcccttgattttcttctccatcaacaccagtatatataggcataaacttaatattttcttctttaactgtattaccatcaatatcgctaatttgtgcccaagcccaattaccattttgaaccatagcacaatcacctaatgcaaattcagccattgcatcatcaacactcttattacctaatacacctttttctgaaactgagttattagtatacaagtcatatatatttttaaagttattattatacttaaaatcaatttccttggcatctaatcctgtttgaagaacatctccattttccccagcatcatctttaaattcataatatagtggtaaatcagctaaatgagtttcccatctccacgcattacctgatgccattgaagtagatgcaaacacaccttgaattcctaattcatctttatttgcttccatatcttctacaacagccttcaatttatcaaaattattaatgtcatctatagatgtaacatcagttgccttatttgataaagcaaaatacttttgcattatttcatcattataaatgattccatatccctcaacggcataaggaataccataaacaccatcaccatctgttactgctaaagttttatcaagtaaatgactatatatttctgtatcttttagatctaaacaatagtctttccaagattgatatccaactggtccattaatttggaatattgttggagcatctttctttgcaatttcagattttaacgtttgttcataagtaccactagctgcagtttcaacttttacctttactccagtttcagcttcataatcttcagctatctttttatatacatctgcaatttctggtttgaaatttaagaaataaatttcctctcctgctgatttagaatcacttgtagcatcaccagtactgtcccccttacttccacatcctacaaatgcacttgcaaccaatgttgttgcaacagcaatagctaatagttttttaatcttcataaacttccctctccccttaaacatactttatatataaatgacctacagatttactgtaaatctttacatagcattttaaaaaatatattctgatttgaaattggaatggttgctggtaccgtttcctatttgtaataaaaaaatttctttaaaagttttttattactttaaatcatcttatatttttattctactgcaaatttttgtttaattcaattcatttttcctttttttactttttttattaatccactcttttttcatgtaactaatttgaattattaataaataattttccaaattttaactgtttcgtatttattttaacatttacatggttgtttgttttgtaaattttcataaataaagagtaattttaatttaaactttaaaactactctttatttattatctattaaatattctatttaaatttatattttcctcaaaaagttttgctaattcatcatattgatttaatttatactttttataatcaattaactctttatctagaatattaatgcctttatttactgttagtgagtttataaatgttctaaggaaaattccttcatcaaaaattccatgcaagtaggtgccaaaaacattttctttaaatagacctaatatatccccatctttattttcaataaacacttcgcttttttctttaacattactaactccattatgtatttcataacctgatacagttattccaacacattctgataatgaattacaaatgttttttatatatccagtagtttgcttagttgttttttctttattaaaaatagtatcaacgcttaaaaaaccaaaacctttctcagctgtaatctctccctctacaccttcactatctatgatattttctcctaacatttgataccctccacaaatgcccaatatcattgttcccttgtttttaagttcaataattttattaaaaatcccatttttcttaattacttttaaatcattaatcgtatttttacttcctggaataattactaaatctggatcattaatatcatttatattttctacatatctgacactaacaccatctaagatttctaaactattaaaatcagtaaaattagacatatgtggtaaccttataactactatatctaagtcttctattttattatttcttattctttcagtaacactatcttcatcttcaatatctaatttaaaataaggtaatactcctaatacaggtatattaattatttcttctaactgcctcattgcatctttaaaataatcaacatttcccctaaatttattaataataacacccttaactctttttctttcactttcttcaagtaacattaaggttccaactacagaagcaaatactccacctctatcaatatctgctactaaaatcacatctgaatcagatgcttttgccatagacatattagctatatctgtttctcttagatttatttcagcacagcttccagagccctctaatatcataacctcataatctcttgagaaattttcaaaagtctcttttactattttcttcaactctttatttaattccttatatttataagaatccatcatagaatgaactttaccatttacaattacttgggttttattatttccacttggctttaataaaacggggttcatataagccataggttttaacccacaagcctctgcttgtacaacctgtgccctccccatttctaagccatcctcagttacatatgagttcaaggatatatttaatgctttaaatggagctactttaaaacctttatttttataatatctacataaagctgttgctactgtactttttcctacaccagaagctgttcctaaaaccattatcttattcatttttactttcctttacatctaaaaaaccatgtgtttcattttttataatattagaatgttcaaattttattggatacttaaatataggaccatcatatacaaaagtatgatattctccattttctccacaagcatcagagcctgtttcttttatatctttaactacttcttttgttaaaactttacccagaaaatcttcccccatacatttaagctttacattttttataactgttttaaatccattgtctataaattcatatactaattcttctctattttcttgccatagtggaaaaattgcttctatcccagcttcatcacatcttgcagtacaccattctctatgtagttctaaatctatatccccaaaaacacaagaatctattttaaacttctccttagctttcaataattcttcagtaaatttaatttcgtaatcatcaccttttgtttctgctaatattaacggtatatttaatgatttagcaacatcctctattaactctctagggactccatgaaaccaggacctatcctcatcctttttaacagttacaagtaatcctgctggaatatttcctccctttatcattctatacaatgctaaagtactatcctttccacaactatatgacatcacaaactttttcatatactacctccacttttttaaaacctcaagcataaacccttttacatcaattccataaacttttttcagattttcttcagttaatacctctttaggatttcctgaacttataatttctccatcattcatcattactactttttcaccaaatgcttgaactaaatttaaatcatgtaataccgcaacaataattttattatttttcttagtccatttgtttaaataatctaatatttctatttggcattttaaatctaaatgatttgtaggttcatctaaaagaattatatctggatcttgcgcaaaagccctagctaaatatactctttgaagttgtcctcctgataattcacttataagtttatccttaatatcaattaaacctacattttcgatactttttagaattatttcctcatcctctttatttatctttgaaaatactccttttaaatgagcatatctccctaaagatactgtttcataaactgtatatggaaagtatatgttactagcttgtgacattaatgcaacgttttttgctaaatcttttctatttaatttacttatttctttagaatctaatgttatatttcctttatactctaataaatttgctattgactttaaaagtgtacttttcccacaaccattaggtccaactatgcaaagactttttcctctctcaacactaaaacttacccctttaacaatttctttattatcatatccacatctaactttattaacttctagcattaaaataccacctactttgactttttaaaatatatataagcaaaaaatggtccaccaattaatgctgttattgcgccaactggtaattctgatggaactacaatagttcttgctactaaatctgtcattatcatcatacatccaccaaaaacaacagacatcggtataacgtaagcatgttttgatccgaatattttcctaacaacatgtggagcaattaaatctataaagcctatggttccactaagtgcaaccgcactccctgtaagcaatgcaacaaataaaaacaaccttcttttaaccttatttgtatctactcctattgtttttgctgcttcttctccaaatgttaacacatccatttctttaaaataaaaagatacacctaaaatcccactagcaaaaaatggtgcacatgctttaacataactccatcctctcatagaaaatgaccccatagaccacatagttatgctttgcattttatctgatgctaaagctgaaatagtagttaatgctgcactaaaaaatagggataataccatacctgcaagtattattgttgtgttagacattcccttatctactttttctgaaaactttagtactattatcatagtaattaaactacaagcaaaccctactactggcatagttaatcttcccaaaaacggaattgatattcctgttactattataatacctacacctaatgaagcacctgatgataatcctaaagtatatggtgatgctaattgattttttaaaactgattgtactattgcaccactagcagcaagggacccaccaaccataaatgcaagtaaaactcttggtaatcttaaattccatattatagatacttgcttaggttcaattccatcaaacaaagggacactaaaaatcttattagctactatagaaaaagtatccaatatgctaatattggaacttcctaaggaagttccaatacatatagctaataataccaatggaattgataaaattaataatattttatttttataggtctttatattcatctggataaatagcttttgctatttcctttaatgcttttataacattttgtgatgctcttgaagatgaatttttatctatttgatatacatctccattttgcacagcagttattgtgtcccaaccttctctgctttttacatcttcctcagcagttaaccctgcttcattagttccaggagtatttactaaaataacatctggattagcatctaaaacagcttctggtgttactgttatccatgaattttcttctccaaaaatattagtagctcctactgtttctattagctcatttaagaaagtatcatgtccaaatgtattaagccctgctccagctccaatttcaaaataaacattctttttatctgctatagtatctccaattgattttattttagaaacttcgtctttcatagaatcaactatttctttactctttttttctgtacctgttaagcttgcaataaactctatatcaccatatattccatcaatgctataactacttggaatatatacaactgtaataccagcttcttttattaaggcaaatggatcttcatctccagatttgttatgccctgatgctataactatatctggatttaaagaaattatcgtttctgcatctggatttctaaaatctattttaggtaaatcttcacttatcccttcaacatcagccgaatatttatctacagccactaatttatctgctaaacctaattctactaatatttcagtattagatggtgctgtagaaataatactattaatctcactaggaacgttaaactcatttccttctctatctttcattgttgtagacttgcttgaacatcctacaaatatcatcatagccatcataaatgtaagggctaatgataaaacttttttgatttttttcattactattcctcctaaatgtatactttagagtggtgtaatttagttagtaatatattagttagatttttcatatatatttttatattaactctaatccaattaattttttctaactaaaaagagcgctttcatcttgagagcgctctaaaatacataataattttgataacgtcttaatacttattaacaataaatattcataaaataaacttaatattaataatttattaactttattttctaatacttaaaatctaaaaacaaatccatattaattctattatcttttattcgtatctattatctcaccctcagaagataatattatcatcatagtaggcaggtctcccgacttaacttcattctactctccataccttcccgtatttttatacagtggtaatacatgaatttcgtcagttttacggttactggggtagtttaggactttaacctaattccctattaagtttaaaaaacacctattacgcattaaaattcataatgattatatctttatgtattttatttgtcaaataaaatctgccttaattcagaaatcaatttattattttcttctcttgttcttactgcaactctataaaaactattatttagccctatataattatcacaacttctaactagtatttttcttttaattaattcgctttttaaatctaaattggttaataatttaaacattataaaattaacacttggctcaaatacatataaacattttatttcttttaaagcactatataagtattctttctcaccttttatatattctatactttttttaatataatctttttcatttaatcccttagttataccttcagctaccataacatttatactccaaggcacagtaactttatttaattgatttatagtttccttatttgtacataatccatatcctattctagctcctggaattgcaaaaaacttagttaacgattttacaattattagattttcataatcaactaataatttattgcttgaatattcttcattttccttaacaaagtctaaaaaagactcatcaataactactgttgtatttgtaatcaatgccttatttaatacttttcttataaattcacctctagttaaaactcctgttggattattaggattacaaataaaaactatatctatattattttttatattatctataaactccttatctaaattaaaattattagattcctttaatttataatattctatctctccatcaacacttaaaattgcttcttcatactctgaaaaagttggtgctggtaacaatgcctttttaggctttaaagcacgtactatattaaatattacttctgcagcaccatttcctaaagttatattgcttatatttattccttcaaactttccaatggaattctttaaatcaaaataagttatatctggatatttaactactttatcaattgcatctatcatggcctttttaatattttcatttgtgcctaatgggtttatattagctgaaaaatccataatttcacttggatttaatttatattttcttgcaatttcttcagtatttccaccatgaacagccaaaactatacctccttaaaaaataatacttataccccaatttataattattgccataacgcaacctaatatagaactaccatataatatattatttgtattattaaccttatcgatatctattttttctatatcatcacctatagttggtttttctacaagctttccaaaataatagtttgccccacctaactgaacatttaaagcacctgctacagctgcttctgggtgtgcactattcgggctactatgattatttttatcccttttataaattttaaaactatttttataatctaaacctaaaataaaagatactactccaataaaatatccacttaatcttgcaggaatataattaaatacatcatctaattttgctggaaaatatccaaattcaatatacttatcatttttatatccaaacatagagtccatagtatttactgccttatataaaaatgctaatggcgctcctcctatcccagcataaaaaagtggtgctataactccatcagacatattttcagctacagtttctacaaccgcctttaatatttcttcttttcctaagctttgtgtatctctccctactatatatgataattgccttcttgctccttcaatatcatctttaataacatatttaacaacctttaacccctcatccttaagtgcctttgttgatatacaaaaataaatcattatagcccctagtatcattgatataattggactaatgttatatgtaactttaattaataaataattaaatataaatactactgaaattactactatccaagttaataagcctgcaacttttaagtatgtctttaatatgtttctaaagaattcttccaccttcttgcataatgctcctattattctaattggatgaataggattttgtggatcacctattattaagtctaataaaaaccctaatattatttctatcatttttctaacctttctataactaaattttatttatctctttaaatttaatattattatctaccttttctaaaataatttcatagcctcttccacatgctggttgatgctcataaaaacttttactgctatcataaaatatttctaatatagttcctattgtaccaccatgcgaaactaaaactactttcctcataccttctaaataacacatatctataaacagattaaatacttcttttattctttttttatattgactcttactttctccattaggacataatacttgtccgcttttatctgtaatccacttaatatattctttattttctttaagcatatcataacttttcatttcaaaatctccaaaattatattcccaaaactcattaatttcactatatgttttttggggatataaaatttctaatgtttcatttgctctttttgctccgctactaaaaagactagtacactctggatactttactgtatttttaatatcatataattctttttttcctctttcacttaatgatatatccgtctttccacaatacagatgcttttcattagcttctgtttttccatgcctaattaaataaacctttagctttttcataccatcttttctccttacaattatctcttacgagaatatcatttttaaatcttttccacaactaagtttttgttaattattatattatttaatttaactacctttgttttaactgttactataagtaaattttagttaatttctaaattctttattaatatttttaacagtgatcctgaattgatttcaaagggtataccatcattaaacatatatttctttggattttttatgatggcattacaatttgcatgacaagcaaccttcgttgcattaaaaagtccaaagcaatcaatatttttctcattgcttcgtaaagttataattgtaattccagttacactaattttgcctaatttatttaacttaggagtttatggtgtatttttagctgaatcaatttctaactttatctgtgaaatttccagccttacaactatactacttacagtatggccatctttaaaaaaagaaaaaccaacaaataatttttgttggctaaatctagtatataaacttaattcttaacttttaattattgttggtataccacaaaaaactctatatacacaggaagattcttttgataaatattgaagacatcttcctgtttcttctctccacattctatcttctttttttaatggaactattccacttgatatttcgtcagaaattattattttatctttaaataaatttatattttcttttatatattcaagtgaacttttatttttcaatgtattattatatgtaaatttatgaattccgcaaataacttttttagaaaaatctattttatcatcattacagtaaaatatattctcttcatcaatattaaacttttctttgataaaatcttttttcccgttatatgctccaccaaaaactaatatcatgtttttctccttagaactaaatttgttttattatgaatatctaatattaaataaaacttaaaactaaaactccaatagcttctgcaataacaagcccatatccagcactatctccagacattccatcaaattctttagctgcattattaactaaaaaagtacttattaaaatcattcctaagctaattattaatccatatattccaaaaataactactgaaattacacttgctattattaagcctaataacaatataatcttatctacttttccagtcccttgtttgaaaaatgctcctaacgaacttcctttcattgattcttttgataataataaatatcccattaaacttcttgatataataggtattaaaattaatcctacagaactactattaagattattaatagtgctttcattaatattattgcttattactgtataaagtgtagaaaagtttactataaataacataattacagatataactgcaaacgccccagtatgaggatcctttaatattcttaacttctcctgcttatcccttctagaaagaagtgcatcacaaacatccatatatccgtctaaatgaagcattccagttaaaacaaatggtgttattaacgtaactgcagtagttaccatagtgctagcccctaataaatttagtattctaaaaactccataccaaataacacctacaattaaccctattataggataaaacttcattatattttttccaccttcatcatcccattcatatctaggtaatggaataatagtaaacatgcttattgccattaaaaatcccttaaaatattttttcatttttcctcctttggattcgtctatgactgcattatatttctttacccttatgataaattatatttccataagaacattcaactactgtatcagctatctttgctaattttctatttataattcctatttcttttctgaaactttctgtataacaatcatattcaatactatcactaaataaataatctgatactataactatatttttagaattattaataatttctaatactccagccaaaatctcctcactaacatctttataaaactctttccccttaaacatagaatttgtaataagagatgttatactatctattaaaacagtatcttctgctcctataatctttgaaactttactcatatttaatgtttcttctattgtattaaatccatacccttctctttctcttaaatgattttctatcctttttaaatcttctaagtcgtatggattcatcgttgcaacataatataattttccaaattctctttctataactctatctaactgagtctttataggactttttaaactttcatttaataacttagctaaattttgcgcaaacattgattttccacttttagctccaccaactactaaaacaatcatcttatctcctaaactatatagttttcttcccctctaacttcctctaaataatcatcatttatttcggcttcatcaaatgttgccatattgttcatcattgcacaactaaattcaattactgaaaatgctataggacatccgctaccttctcctaatctcatatctaaattgagcataggctctaagtctaattctttcatagcaatattataacctatttctttagagcagtgtgatgttattaaatactctctaactaatgggttcatccttactgctgctaatgcagccaccactgatataaatccatctataactataggaattttataatatgcagctcctaaaaacactcctaccattccagctatatcaaatcctccaactttagaaagtacatcaataggatcttttttatctggattattgactttaatggcttctgatactacccattttttcttttcaaaagcttctttagttattcctgcacccttgccaacagcttcttcgatactacatccagataaacttacaaggatagaactacttgttgttgtatttcctatgcccatttctccaacacctaatatgttatatccctcttcataagctttccctgccatttcaattcctatatttattgctcttatacattcttcatagctcatagcttgtcctttaactatgttgtaagttccttttcttatttttctatctatagctcctggaatgttcctatctgtatttactcctatatcaacaacttttaaatcacaattattttctttagcaagtacagcaacacctgttagtccccttgaaaagttaattgtttgtgccagtgttacactttgaggtgctgaagcaactccttcctctacaaccccattatctgatgacattataataatacattttttattgatggagttttttaccttacctgtaatcccagcaagctttattgcaatgtcttccaattttcctaaacttcctaaaggttttgcaagtgaatcaactcttactttagcttcttccataacctcattatttaatccttttataccattaataacttttttcaagattaatttttcatctatcatgatttcaccccaattatttatttaaaatatcctctttttttgttataatactttataatttgtttaaatgtcaacaatgatatataaagcaactttcatttaggagaacaatatgaacactactgtaattaattttttacaaaatgaagtaaagtggaataaattaaacatatcatctatagaaaaaataggtggtcttagtagcgaaaactataaaatttcttataataataattattattttgtaaaaatttgcacacataattatttacatactgatagggaaaatgaattatcaataataaataaagctataaacataaatttagcgccacatttatattatttttctactaaaacaggaaatatgattagcacttggattaatggtactatgccctccttaaatgatttttcttcaactaaatttctgtataaactttctgtttctttaaatagttttcataatttaaaatgccaaaaatattttaatccttttaatcatataagaaaaagaatagagctatgtaaagatttaaagctacccttgcctaaatctataaatgcacttttagattatttgaaatttttagaagttaaacttagtaaaaatcctttaataggactttgtcataatgacttaaatgcttcaaatattattttgactgatgataatttgcattttgtagattatgaatactcttctatgggtgatgtattttttgacttagcaacaatatcttggttcttaaatgaagaatctagaaaaaaattattagaactttactttaatgaatctaatgaaaaacattatgaaaaattattagattatcttttcatagtcaaattttataatgccacttggtcactgcttaaatcttctgactccaattctgactatgattatttaactggagccgaaataatatttaatgatttactcgattataactctatacgaaatttttaataaaagaaatgaaaatcctaagtataaattacactaatatttcaaattattattcaaaatcttttgttaactacattttatattactatgtattattcctcagtaaaaaagaataacatttctgttattcttttttactaccttttgctgttacaattattttccaaacaattttctaataaatcacttattgcatttgttagttgacaatttgaattcataaaatagcaattagtcatttgattattccaagcatataaaaatattaggaataatactaaattcataaatcgttgtccgtaacactgtagtaaatttaataattgacaagctaaaaattcatttgttccttctgtatcactattattaccacaataattttcacaaagttcttctaactcatcagaatttaagtcatttaatatatcatttaaattagatgtcgatctcaatgtactcaattttcttttcctctcaaaagttatctaatgcttcataatacgccaaaaacatagacattgctacacttttatatcttttatctgagttaattatttatgtaaattattccttttcttaataactcttttagctaaatttatatttattaaacactcactgataataatatgtaataatcaataaaaaaaatgttacaacacaaaaagtcttgtaacatttttaaaactatatattaaacttttatacttccatgctttaacaaatgatttattcttttaaaatatgttatacctaatggaattgccgctgcaaaccaagctactggatctgctaagcatattcctaaaaactctatatatcttggtaatgtaaatgctactactgctcttgcaataagctcatatgctcctgccatcattggaacaaatgaatcacctattccttgaagtgcatttctatatataaatattaatccaagaggtataaagaatattgctgatatattaagtacttgttgagcatagcttaatatttctgcatctggattatttataaacatcataacaaaatatttaccaaggaatattaatactgctgcagaaataagactagtcactatagagattttagtacatgccttaacaccttcttttatacgatcatacttcttagcgccaagattttgaccacaatatgtagccatagttacaccaaaagtaattgctggctgcattacaagctgaagtgcttttgaagctgcagtatatgatgcaataatagtagatccaaatacatttaatgcagattgcactgtcattattccaattgcagttattgaaaattgaagtgccattggaattcctatttttaaatgcttatgataatatcttttcttaactttaaaatcttctttcttaagtcttaaaatagtaaatctcttatatgtatatattaagcaaagtattgctgatacaccttgagaaataattgttgcataggcagcacctgcaacccccatattaaagttaattataaatactaaatctaaaattacatttaatactgaagaaactattaagaaatataatggtgttttactatcacctaatgctcttaatatacttgcaattaggttatatgcaacagttgctacaactccagcataaattatttttatatataaatacgcatcacctataatgttttcaggtgtattcattaatcttaataaaggcatagctcctaataagctaactattgtaattaccactactgaaattacagttaatgtaacagcactagcaactgctttacgtaatcccttttcatctttagctccaaatctctgagaaactaatactgcaaacccactagataatccagttgcaaatccattaactaaaaataccattgaactagttgctccaacagctgctaatgcatctactccaacaaatctaccaactattatagtatcaaccatactataaaactgttggaatacatttcctattaataaaggtattgaaaatagtagaattaactttactggattacctttagtcatatcattcgtcatattgtttttcatccactcatctccccctaacgtcttatttcacaattaaatagaatatcatctttattatacttttgcaaaacaaattttaagattcaataataaattattttctcaattctttacttacttctccaataatcttaattccttcttttatatcattaattgataatctagaaagccctaaccttaaagtatttttgcaactataatcaactgaaaatatatctccaggggtaaatataactccccttttatgacactcatctaaaagccttctagaatctaccccttctattccaatataaatatgcaatccaccttcaccccatataaatgtggacttaatatatttattaatatattctactgcaacctcatatttttccttatatacttttcttacttttttaatttgcctttcaaatgcccctgaacgtaaatattcatataatatcccttgatctaaaaatgatgtatgaatatttttacatctttttacactttccaatatatcaataacatttttatctgcaagaatccagcctactcttattcctggaaatagtatttttgaaaaactcccaatgtatataactccactcccaccattatcaagagccgccattggagatacatgagcactattatataaaagttcttcattaaaaccatcttcaattatgggaacattataccgcttaaacaaattatagacggaataccgtttttcacccttcattacaattcctgttggattatgatatgaagggattaaatatccaaactttatatcattagattttaacttttcttccaactcattagtatctattccatcttcattcatcgaaacccctataacatctaatccatgaactttcataattttaatagctgtattatgagttggattttcacaaataattttatctcctctatttgtataggcagttagaagcatttcaagtccttctgtaaatccattagtaattataatatctttccctgttgcatctactccctttgccttcatatactttaaaagatattcaataagaggcttatagccctttgcatatccataatttaatattttatgtccttctattgaaattctatttaaaaatgcttttttaaactcctccatatcaaataactcaccatcaggtgatatacttttaaaagatattaaattcttttcccatggtatttcactttttacaatatccaatttttctgcaagttttccataatcattagctcgctgattccaagaaactttccatccatcttcatttaccgatttaacctctgaaacaaaggttcctcttccttttactgtatataagacgccttcttcttcaaggttttcatatgcagttattacagagtttctactaaccccaagtaatttagaaagctccctggtagcagggagctttccatttgaaacaagaagattactagcaatcatgctctttatataattttctatttgcacatataacggctcttcatcattaaagtcaattttagaaaatatcattatcttacaactcctaaagtagtgaatactctattatttcatctaatagatcactaaattctaatcctcgcacctttgcacttttaggaataagactttgtgttgtcattcctggcaaggtatttacttctagtaaataaggtacttcatctcttattatcatatcaattcgtacatagctattgcaacctaaactatcccaaacattttttgatatattattaattttctcttgtagcttttcttctaataaaactacttcctcttttgctccattttcctcatatttagatttataatcaaagaattctcccttttgtgatttaatcataactgtaggaaaaacttctccatttaatataaatgaagttatctcctctccatttatatactcttctatcattacttcagtatcatactttaatccttctcttactgccatttctacttcatcttcacttctaacaaagaaggtagcaacacttgaacctcctttattaggtttaataaatacaggatactgtaactcctttattttttcataatctatttcctcagctgatctaactataatccattttgcagtatcaatcccaacagattttactaaagttttagttaaccctttgttcatacatatagcacttggtaacactttacatccactatacggtattcccatagtttcaaaaacaccttggattgttccatcttctccaaatttaccatgcaaagcaataaaagcaaaatcaattccttttactttttctataacctcttgctttgaatttattattataggaattatttcttcatatttatctttatttaaattttttattacttgctcacctgattttaaacttacttctctttctgatgatactccacccattattacaccaattttcatcaatatcactcctgctttttaatctttactttattttattaattatatgaaaaataaaaaagcaccacagcaaagctatttttctttaactgtggtaccatttttctttatatattacttttatcttattctataagtctttattaaccgtaattaactacattagacctattttcaatttaaaaaattatttatttactaaatctaaaatcatatctaattaagaatttatatttcccctcctattgattatctaataaaaatattatataacaacatttttattagtttttttcatataattgatagctataataacagtcactaattcactaataggtacagttaaccatatacctatatcacctaaaatcataggtaaagtaattataaatacaattattaaaattacacctcttaacactgaaatgatagcggaagtccttgcgttttcaagtgctgtgaaataagctgatgctaaaatatttaatccattaaaaacaaaagctatagaatataaattagtagcttcagtagtaattttaactaattcactatctccatcaacaaacattgcaataagtgtttctccaccaaataccataataatagcactaaatactccaatgatacttatagttaatatagctaactttaaaatcttacctattctttcattattatttgctccataattaaagctaattataggactgattccattgcatattcccgaaaatacagctgttactagcgatgctatataaagaataattgaaaaagcagatacccccatttcaccaatcctaaccattaatacaatattaaatatatatgttgaaaaagcaactgcaaattgtgttataccctctgatgatccattataaaatatcctaactattttttttaaatcaaatttaactttacagaacttcagtatagaatctctttttagatattgagttaatgcaaataaaaaaccaactgtaaaggcaattcctgatgcaaaacctgctcctgctaaacctagattcatctttactataaatatataatctaatactatgtttagtactgaactaataatgtcagctaccatagcatgatttggtttccccataactctaagtccattacttaaatatgaacttcccacaaacgtagctaaaaataaacataatgatactaaatattctacaactaaaggtactaaatcatcattagctcctagaattcttgctatagttgatgaaaaaataacagtaaatactgataacgttaatgttataataattaatgaataaaaagctaaactaaaagtctttcttgcttcatctctattaccttttccaagctctatactagtgatagttcctccccctatagcaaccatgattcctatagccattgcaataccaaagaagggcattgctatattaactgctgataatcccttagaacctactacatttccaacaaatattccatctacaactatatatattgaaaatactatcatagctataactgatggtattgaatacttcacaaataacttacctatattttcttttcctaatgataaatccatactactcacttcctttctttaaaaataataaaccttagagtaactctaaggtcaatgcattttttaaaatctatttttgcccttttttatacctccatatcatatatttataataattcttaaattttatattaatatattaatttattattgtctatttttataccctctattagtgtatgtaatcttaaatccccctaaaaactaactagaaatcttaaagttaatattaaactataaataaattttttattataaaaactattttctcatttatatattctagaaaaatatacttattatatattgacttgtttttgtttttattagataataattattattaaataataatttgatttataggaggatttttatgaataatattattaatgggtcttggagtgactttagagaattaactttagttgataaggttgaagtctgtccttcaattgtttctttttattttaaatcaaaagatggaggtaagcttgttaaaccaaaggctggacaatttttaccttttaaaatcaaaactgataatcctaaatataaagatataatgagaacatatagcctttcaatgtttcctaatgatgatacttatagaattagtgtaaaaaaaattgatggtggtctaattagtacttatttacatgaaaatcttaatataggcgattctattgaagctatgattcctatgggtgtctttactgtaaaaaataaaaagaatgatattgttttaatttccggcggaataggtgttacccctcttttagccatgctttatgaagaatcttcatctagaaataatattcactttattcaagcagttcaaaactctagtttacacccatttaagaatgatatagaatctattgctaaaattagagatattaaaaacactgtattttattcaaatccattggatagtgataaagaaggaatagattataactatactggatatgttaataagaattatttaaaagacaatgttaacttagattcagatttttatctttgtggccctcctgttttcatgaaggctgtagaaagcattttagttgaacttggagttgataattctaaaattaattatgagctttttagcaaataattattagagctatagcccttaaatatggctatagctcttcattcataatgtaactttactccctcaatattcttttcatagcattttttacataacacaatcaattcattactgctactattaaaattattttcataaacctccaaattagctatatttccacattcttcacatttatattttgccttttctaatgcatcttgacgttttaggttccactcttcttcaatatgtatatcattaacttctttattattatttttactatctctataaataaatatattgtttccttcactaaagacattttttattttacctataataatcttcctaaaactaaataattctcttctctcttttcctcctatttttttatactctattaccattcttatacttataattttgattaagtaaattcctaatactacataaattaaattaaacataaacatcaccattttttatctttaaccatttataaaaatttatacatttattctttagctatatattcagtaaaatgaaagttaaatttaattttattcatatattattaaaaccttttaatcttttttctaaaaaatcctatttcccttacaatttcatattgtatgattttattttatatggtaaaatttattaaaaatgcaagttttcaaaaaaaatcattcattttttctaaaaatagggggctaatatgaaaaaaaaattaggattaacaacaaaaatttttattggactaatactaggggcaatttgcggcataattctttatggattagttccagctggaacaataagagatgatatacttattaacggtatttttaaagtggtaggaaaaggattcttaagggcaatgcaaatgctagttgtacctttagtattttgttctttagtttgtggaagtatggctataggtgatactaaaaaattaggtcgtgtcggtgtaaaaactatagttttttatctttttacaactgctattgcaattagtttagcaatcggtgtaggtaaattaattaatcctggaattggattggatatgagcaatattgaaattgctgaaactaccgtaagtgaagcaacttcagtatcagatgttcttttagatataattccaacaaatcctatttcggctttagcaaatgggaatatgttgcaaattatatttttttcaattctagttggaatcatacttgctatgcttaatgaaaaggctaaaacagttgcaaatttctttagtgaattcaacgaaataatgatgaaaatgactatgatagtgatgaaggctgctccacttggagtattttgtttaatagctacaacattctctaatattggttggagtgcatttactccaatgctaaaatatatatttgcagtaatgttagcattagtgatgcaatgcttaataacttatatggcaatgttaaaagtatttacaaaattaaatcctttaacattcttgaaaaagttcttccctgtaatgagttttgctttttcaacatcatcttctaatgcaacaatccctcttagcatcgaaactcttgataatgaaatgggtgtttctgaaaagatatcatcttttacagttccattaggtgctaccataaatatggatggtactgcaataatgcaaggtgtagcagttgtttttatttctcaagcttttggaattgaactaggtttaaatgcttatcttacagttatattaacagccacactagcttctataggaactgcaggtgtaccaggtgttggacttattacattatcaatggttcttaattcagtaggacttcctgtagaaggtataggaataatcatgggaattgatagaattcttgatatgacaagaactgctgttaatgttacaggagatgcaatttgtactactatcgttgcaaagcaagaaggtgaatttaacgaagaaaccttttattcagatgtagttgaacttgatgaagcaatttaatataaaaataattacctacttaatataaattaaagtaggtaattattttataactattaatttaagtttggaaaattaaatatattttctattcctctctttactttagggttatctccatgaattaatttttgctcttcctcttcacaaattataactccatcaattaaaccttcactatttttattgttaatatcattttcattattcataaaaatacacctcttataattttgttatgttattattattccgctatgtattcttatttataaattaataataaaaaaacttttatatattactctatattaaattaatatatagaagtttaaatcatctactaaaattgtcttactattttcaatgcaaaaactgtagaaattcttctttttaacttttcatttaaagctaactctattattctattatcattcatttcaaatgtaaaaatgcttaatccattaactttagagttataataagaaactttatttttattattagtattattattactttcataaacttttcttacatcttccattgaaatgttagcaactacttttcttttactttcattataaattttagttatagtaatacttttattatataattcatactcatattcaacataacataaataacttaaaataaaagatcctactgctaataataacataacaattgcaataactaatgatgataataaaaagaaagctgacaatactactaataccatagctaatccttgtaatagcttaaccattccctttcccttatcacattcaattaattgttcaaaaatctcatccatactttttcctcccattacccatcattgatataccataattaaattatatcaaacttataactacattaatacttaatagagttataatataaataattattatagtcccttatagtaattaattaacttctccttagtattaatccccatattttgtggtattattaattcgtcaatatcttttccatttagtttaccatctactatatattctttttctaagaacttttggccccatgttgctattttatctatttctggtgtatcaacatttaatatctctgcaaatgcttttaaaatacataaaccaaattttatatcttcaataaaataccttgaagatttatctggaatatatccaccttctattttaaccataggcgaatcaattcctataaacccaggtgctgtatttatcttttcacttaattcttctggagtatttatattatatcttgtttttattttttcaatatcactaggatcaaaatcaccattttcattaaatgcattgaaaatttcttctaactcctcatctaactttaataattctgtagatgctaaagttccccactcctcataaaaatatggatttctttcatatacatgttctccttcaacataatcatagaataattcatataatcttgaaggatgcatagtagggttagaaggtgataatgttattgctaaatatgaatttaatggaatacaaggaatatctatgaaactactcatatccttagcaaccttttcagaatattctcctggtatacttctaattttcataaatggatttttttgctttaatacaacactttctccatacttttcaagtctaataatagaaggtactctttgagatccaaagaatatgcatcctttatctaaaagtttatctattaaatactcttttccaccaaaacctggaattgcaccaacaacagcaccttcttttaaatatggcagtattgattctattgtcttttccatcataaaagaaggatatgtaattaatatataatcggcatcattaacagcctcttcataactatttgttatacaatgtaaatttatatgatgtgttatatttttttcctcttcaactaaagcaatagtttcattaaacgcttctggtttcgaagtatgtaaccaaaccttattttcatgtttcattgagatatatgcagctaaatatgttcctatatttcccgcacctataatacaaatattcatttttatcctcctagttctttcttactttaagctttttataattatatattatcatcttttacagtaataacttgtataccttttgtaaaattttacttattaattgtattaaactataataatatctaaatattgtgattatataattttcacatataattattttatactattacttaataatatttcaattgattataacttatatttactatttaaaatcacatacaatagaaaaaactcatatcttgtaatataacaataaatctaggtagattatatgactttatcaactatacattttatttatatattttttacagttttaatattaatatctattttcaggaaaaaggatataactataatttgtgtccttggtgttttatcaattgctctgtatagcagtaaatctataccattatcaataatttcagtatttaatggtttcttatatgctataacagaattattgcctattattttaataatatctatcattactgcttttagtaaattattatctgtaactggcataaacgaagccttagtcgcaccattatcaaaactaataaaaaataaatatatagcttattgggttatcggaataacaatgatgattatttcttggtttttctggccttctcctgcagttgcattaatcggtgcagttttaattccagttgcaaaaaaagttggattaccaaaactatctgctgcaatggctatgaatttatttggacatggaatagcattatcaagcgatattataattcaaggagcatctaaattaactgctaacgctgctaatataagtattagctctcttaattctactcttattcccctagaaatagtaatgggaattaccaccacagtaattgccttttttatagttttgagagatatcaaaaaaaatactgtttctcaaagttattctgagcaaataacacaggactctaataaacctgcttcaaatatcgtcaagttatctaaaaaacaaaaaaacttatatgctttattagtttttgctggatatcttttagatatcatattaatgatagtattttctttaactggaggagatgcaactgctttagttggtggtaccactttatttttgttaattataatttttcttggaaactataaatttaatagtatgaaacaaataactccatatattgttgatggttttcaatttgcttttaaagtatttggtgccgttatccctgtagcaacttttttctatcttggtggaagtggctttgaatcaattatagggactatattgcctccaaattctaatggtattattaacgatcttggaattgcacttgctaattcagtaccattaaataaaacaattgcaacagcaacagtttctggtgtaggtatacttactggccttgatggatctggtttttctggtctatccttagtaggttcatctgcaatgctcttctcgcaatcaatgactataaatgtttctgccttagcatcaataggacaaatatgtacaatttggattggtggcggaacattaataccatgggcactaatcccagtagctgcaatttgtgatgtttccccttttgatttggcccgcaaaaatttattacctgtatccattgggctaattgtaacaataatttttgctataatattttttgtataaaatttaatattttattacatggggctgtatcaaaataaattttgataatagccgataaaaaaaggagggttcgaatggtactgcacgggtgactgtgtggaagagtagaacgttgccaggtaatatgaggatctttagctcagttggttagagcaaccggctcataaccggtaggtccggggttcgagtccctgaaggtccaccatttttgggggtatagctcagttgggagagcacttgccttgcacgcaaggggtcaagggttcgaatccctttacctccaccaaagctacgatttatttcgtagctttttttgcgtttattataaaaaatatatgaataatattatttagactttattttttatctaatagtggtattataaatatgaatgtgtattacaatatatgttaaaaactaggtggtaaaaatcgtgttatatagagtaaaacaatttttttgggcaataaaatcattatcagaagatattgataatgactatgtaaataaatttttgaataagaaggaaaaaaggttgtttaatagattaaagaaaatggataagcaacattgtattagagtaagtaaagatgcagttgatttatcaaaagagagagggctaaattcaaaaagagttgcaaaagctgcattgcttcatgatataggaaaaggagaatatggacttaatatagttgaaaaatcagttttagtaatacttaataaagtaagtaatggtaaattaaaaaaatataatactattaaggctgtagactcttattataatcatgcagaaaagggagctaatttattaaaacaatttaatgtatatgataaagaatttttagatacagttagatatcatcacaataaaaatatagtaggaaataaactgctagagataataagagaaagtgataatagaaattaaaggatgggattaattatgaaagctgatgaaagacgaaatgctattatgggaatgttaataaaagaaaaaagagcaattaaaggtacaacattagctgaaaattttaatgttaccagacaaataatagttaaggatatagctatattaagagctaaaggaaataatataatagcaaccccagatggttatatgattaatgatgataatagtagggtaaaatcaataatagcagtaaaacataatgatgatgaaatgtttaatgagatggagattgtagttaaatatggaggtattatagaagatgtaatagttgagcatcctatttatggagagatatgtggagcattaagaataaagaatcttaatgatttaaataagtttagagcttcattagaagatataaaagcaaagccattatcagtacttactgatggaatacatcttcacacaatatctgctgattctgatgagaatatgcagttaataaaagatgaattaaaagaaaagggatttattttataaattaggggaattggattatggattatgatgttttagttttaggtggcggtattattggatgtgctgttgcttatgaattatctaaatataatttaaatatagctgtgattgaaaaggaatatgacattgctgatgatgtatctttcgttaatacttctatagtatatgatggttctgaaacatctaataatgtgatggctggattagagtatataggaaatatattattagaagatttatgtgagaagtttaatgtaccttttaaaagaattggatcattaagagtagttaatgatgataacggggtagttaaattagatgaaatgtatgaaagagctattagaaggggcatagatggtgtttatttagtagagccagatgaagtatatgaaatagaacctaacataaatacagccataaaaaagggcttatattcacaaaatgttgcgatagtagcaccttatgatttagcaatagcatatgctgaagttgcatttgataacggggtcaactttagattagaagaagaagtattaactattcaaaatataacaaaaggcttcagagtcgttacaaataaaaataaattttcatgtaaagtagttattaatacaatagcaaatgaaatttatataaacgaaaaagggatagtagaagaaaaagatacagaagatgatataaattcatttaaaaatatgagttatattttacttgatgataattatgaaaataaattggatagaatagtaacaaaaacttttgataaagatacatttgttgtctcaactccagttttaaatggtggatcattagttggcataaagagcattgaaaaaacaagcttagatgataacttaaattatgccagtaaattattaaagaacttaaacaaaggaaatataaataatttatttagggaaagctatgataaagattctatagtagttgatgaacagcaaataaataagggatatataagtgtaataggaacccattatggaaaggttacattagcgccagcaatagctaagatgctatgtgatactatcagtagcagtttaaattgcagattaaaaaagaactttattgataaacgacgtgaattttataggtttagagaaatggatagaagcgaaattaacgaagtaattaagttagataagagatatggaaagattgtatgcatgtgcaataatgtgtctgaaggagaaatagttgattctattagaaggcctttaggtgcaagaactgttaaaggagttaaaagaagaactggtgccggatttggaaattgtcatggttcatattgcaatgagagaataatacaaatattagctagggaattagataaaaaaattacagatatagttgatgactcaaaaaattctaatataatttctggtagaataaaagaatttaaagaaatatagtaggagtatattatggggaaaaaagatatatttacatcagtagtaagggtaaaaggaagtgacagattcaaggttgttcctgttaaaagtagcgctgaggtagaaagagagttatggattgaaatgtcaaaagttgttagtagattatatgtaagtattcctataaaaatgggaagtattatatgtaagaatatattaaacagtggagtagatataatttgtactagagatattgacaaaaagtagcagactataatatatttaatatattataataatttatttagttaaaccgttgaaaaggctagtaataagattagtgttttaagagagtcagtggttggtgtgaactgatagcaatgttttatgaatccaccttggagggactgtgatgagcagtacggataaacccgttagttttataaagagtggatagtaatgtgtttttatatgcattattatcaattagggtggcaacacggagttcttcgtcccttttgtgggataagagctctttttttatacaagaaaataatttataaaaacaattggaggatattatgttagatttaaaatttgtaagagaaaatccagaaatagttaagcaaaatattaaaaataagttccaagatcaaaagcttggattagttgatgaagttatagctttagatgttgaaagtagagcaacacaacaagaggctgattcattaagatcaaatagaaaaacaatttctaagcaaattggtgcattaatggggcaaggaaagagagaggaagctgaagaattaaaagctaaggttaacgagcaagctaatcgtcttgctgaattagaagttaaagagaatgaacttcaagaaaaaataaaaaatataatgttagtacttcctaacattattgatccaagtgttccaataggaaaagatgatagtgaaaatgtagaagttgaaaaatttggtgaacctgtagttccagaattcgaaattccatatcatacagaaataatggaaaagttaaatggtgttgatttagatggagctagaaaagtagcaggtaatggattctattatttaatgggcgatattgctagattacaatcaggaatattatcttatgctagagatttcatgattgataaaggatttacttactgtatacctccattcatgattcgtagtgaagttgttactggtgttatgagcttcgctgaaatggaatcaatgatgtataagatagaaggtgaagatttatacttaataggtacaagtgaacattctatgataggtaagtttattgatactatattaaaagaagaatctcttcctcaaactttaactagctattcaccatgctttagaaaagagaagggtgctcatggaatagaagaaagaggagtttatagaattcaccaattcgaaaaacaagaaatggtagttgtttgtaaaccagaagaaagtaaagaatggtttgaaaagttatggaagtatacagttgaattattccgttctttagatattcctgttagaacattagaatgttgttcaggagatttagcagatcttaaggttaagtctattgatgttgaagcttggtctccaagacaaaaaaaatacttcgaggttggaagctgctctaatttaggagatgctcaagctagaagattaaagattcgtgtaaatggagaaaatggaagatactttgcacatactttaaataatactgttgttgcaccacctagaatgttaattgcattcttagaaaataacttaaatgaagatggatcaataaatattccagaagctttaagaccatatatgggtggaaaatcagttataaaataataatatatatgagatatgagataattaataataattttctcatatctcatttttatttcatataagataaaagctttactaattaataagcattgacaaattttagggatatgttagatttattatgggtggtattttaattaaaccgcaccatatataatatatttgaaaatttaagaagaaaagaaatagctcatatcaattttgaatgggactaagtagtgtcacactctaatggaggtgataaatataaaatttggatttattggagcaggaaaagttggattttccttaggaaaatatctaaaagaaaataatatacacataagcgggtattatagtaaatcacagcattcagctaaagaagctgcagtttttactaatacacagcaatataacaatttagaaaatttaataaaagatagtgatactatattcattacaacacctgatagcgaaattagtgttgtttggagtgaaatcaaaaaattatctatcaaagataaattaatatgccactgtagtggttctatttcttcagaaatcttttcaaatataaataatcatggtgcctatggttattctattcatcccatgtttgctatttcggacaaatataattcttataaaaatttatctcaagcatttattacaattgaaggacataaaaaacatattgaattttttaagcaacttttttctcaattaggtaatgatgtagctgttatttcaaaagaaaataagactttatatcatgctgcatcagtaactgtcagcaatcttgttttaggattaattaataatggaattaattatcttgaagaatgtggtttcactcaagatatggctatgaaagccctttatccattaattgaatttaacttaaagaatattaaggaaaagggagcagttaatagtttaactggtccaatagaaagaggggatttagttactgtaattaatcatttaaatgttttaagagaagaagataaagaattatataaattattatcaaaaaatattttgaaaatagcaaaggtaaaaaactcagctagagattataaaaatttagatgaatatttaggagaataggttatgaaaaatacagcagttacatttaaacaagctaaggaaaagaaagaaaagcttactatgcttacagcatatgattactctacagcaaagataattgatgaatctggaataaatgggattttagttggagattcattaggaatggtatgtttaggatatgaggatacattatcagttactatggaagatatgatacatcatactagagctgtagcaagagggactaaaaacactttagtagttggagacatgccttttatgtcatatcaaacatcgatttatgatgctgtagttaatgcaggaagattaattaaagaaggaagagcacaagctgttaaattagaaggtggaattgaagtttgcgataaaatagaagcaatagtaaaggcttcaatacctgtcatggctcatattggattaacaccacaatcagttaatgcatttggtgggtttaaggttcaaggtaaagatgaagaagccgcaaaaaatcttattgaagctgctttagcggtagaaaaggcaggagcatttgctgttgtattagaatgtgttccagctaagcttgcagctataataactgaaaaattatctattccaacaataggaataggagcaggagtagaatgtgatgggcaaatacttgtttatcaagatatgttaggaatgtatagtgattttacgcctaaatttgttaagaaatatgaaactttaggtgaaaagatgaatgtagcgttcaaaaaatatattgaagaagttaaagatggtgtttttccagctgcagaacattcttttaaaataaatgatgacgtaattgaaaaattatattaaaggggaagaaaaatgagagtagttgaaaggataaatgatgtaagaagtaccgtaaaggaatggaaatcacaaggcttaaaggttggttttgttccaacaatggggtatttacatgaaggtcatgaaagtcttattaaaaaggcatcagaagagaatgacaaagttgttgtaagcatatttgtaaatcctattcaatttgggcctaaagaggatttagctagttatcctagagatttaaaaagagatagtgaaatttgcgaaagggcaggagctaatcttatattccatccagaaaatgaggaaatgtattttaatgatttttctacatttgttgatatgaatggattaacaaatggattatgtggtaagagcaggcctatacattttagaggtgtatgcactgttgttagtaagttatttaatatcgtagcaccagatagagcttattttggggaaaaagacgctcaacaattagcagtagttaaaaggatggtaagagatttaaatattgatattgagatagttggatgccctatagttagggaagaagatggactagctaaaagttcaagaaacacttatctttcagaagaggaaagagtagctgctactattttaaataagtcattaatgcttggaaaagaagaaattcaaaatggacaaagaaatagttctagcataattaaagttatagaagatagtattaagagtgaaaaattagcaagaattgattacgtagagattgtagatagtagttctttagagaaagttgaagaaattaacaaatcagtattagtagcaatagctgtatttataggaaaaactagattaatagataattttacgtatgagttatagcaaggagagaagaacaatgaaggtaaatatgttaaagggaaagatacacagagcaacagtagtacaagctgaattaaattatgttggaagtattacagttgatgaggatttattagatgcagcaggaatatatgaatatgaaaaggttcatattgttgatatagacaatggagctagatttgaaacatatacaatagctggtgaaagaggatcaggtatgatttgcctaaatggggctgctgcaagatgtgtacaagttggagataaaataatattaatggcttatgctaatttagagacagaggaagtaaaaaatcataagccaaaggttgtttttgttgataatgaaaataaaattagtagaattactagttatgaaaaacacgggcaattatctgaataaaaaaataaaattaatatatttatattagcataaaatgggaatggtaaagtaagaaaatattttagtcttactttaccattttttattaatagttagatgtagtattatgtagttattaagatatgtaattaagaggttttaagatgataaataaaaagcaaataactaaggtatgtaataattgtagtgagtgtgctttaccagttataacttgtatatgcaatagtataaaaaaagttgaaacaaaagctaagtttataattttatctagtgaacgagaagtacatagaaatacgaatacagctaatttattaaaactaataaatccaaaatctactgaaataattatatggaaaagaggagcggtttcagaaaaagttttaaactatattaatagtaatatttatagcacatatttgatatttcctattattaatgaagaaatgaaaaaaagaaaaattcaatatagtaaaagtaatagtatacctgtatttattattgtagatggaacatggaaagaagcttggaagataataagaaaaagcaattacttaaaagatttacctataatatctttagatatagagagaagctcaaagtttagcttacgaagaggacaagaagagggaaatctatgtactatagaaacggcaatagagttacttaagatgaataaagaaaataatataagtgaaattatagataaaagttttgagttatttttagaaagttataaggctggaattagtggtcataaaattaaataaaaaaattgataaaaagtgttgacatagtatttatacattgatataataacaattgttccgaggagagatggtcgagttggtttaaggcaccggtcttgaaaaccggcgtgcgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaggagagatggtcgagttggtttaaggcaccggtcttgaaaaccggcgtgcgtgtgagcgtacccagggttcgaatccctgtctctccgccataagtctttagcattagctaaagacttttttttgcataaaattacaaattggcgtgtaagtatgaataagttaaatgaaatattagaatataataaaatgtttgtagaaaataaagaatatgagaaatataaaacaataaaatatccgggaaaaaatcagcaattttatcttgtatagatacacgattaatggaattattaccaaaggcccttaatttgaaaaaatggagatgctaaaatagtaaaaaatgcaggagctactataatgcattcatttggaagtataataagaagtattatagttgcaatttatgaatttaataaagatgaggtattagtaattggacataaaggttgtgaagtgagcactatagatggtgaaactactattaataaaatagtagaacgtggggtgacgagagaagcaatagaaatattgacgaagtcaggtatagatataaagaagtggttacatggatttgattctatagaacattcagtattagaaagtgtagagttaataaaaaaaacatcctctggtacctaaagatgtaaaagtacatggtttaataatggatccttaaagtggaaagctagaagtaataagtgaagattactaagaaataaaaaaataaaaaaatttttaaaaatgtgttgacataattattaggcattgatataataaatcttgtcttggagagatggtcgagttggtttaaggcaccggtcttgaaaaccggcgtgcgtgtgagcgtacccagggttcgaatccctgtctctccgccataagtggagaattactcaagtggctaaagaggctcccctgctaagggagtaggctggataatactggtgcgagggttcgaatcccttgttctccgccaaaagcatctaacgtttgttagatgtttttttgcgtttaaataaaagatataggcattagtaatattaataagtatattaacagtgtgaaaaaagattaaattccaatttttccataattaataattgtaaacgtaatatttaaatggtatacttttatatagttaagatagtatgacttaaaataggagggtaataaatggaaaagaaatatgttgtaggtgtagatttaggaggaactaaaatttacacagctttagtagatttagaaggaaatattataaaagaaaaaacagttgaaactttagctaatgaaggtgaacaagctgttatgggaagaataatagatactattaattatgttatagatggaactgataaagactcaataagatcaattggaatcggttctccaggtccattagatgttaaaaatggtattataattgaaaattcaaatttaccttttaaaaactttgcaatagtaaagacaataagggaaacatatgatttaccaacttatttagataatgatgctaatgttgctacattaggagagtttatgtttggtgcaggaaagggtactgaaaacatggtatttattacagcaagcacaggaatcggtggtggagctgttttaaatggaaaattatttagaggagctacaggaaatgcattagaagttggacatacaatagttgcaactgaaggtccaagatgtggatgtgggaacgttggatgtgcagaggcatttggttcaggtacagcaattggtaagagagctaaagaagctgtagcaagtaatgtagaaacaacattaaagaactatgaagatgtaacggctaaagaagtgtttaaagaagcagctaacggtgatagagttgctaagaatatattagaaacttcattaacttatcttggaatagcagtagctaatactataactaactttgacccagaaaaagttgttattggtggtggagtagttaatggtggagatatagtgttagatactataagaagagtagtttcagaaagatgcatgaaaacttttgttgaaaactgtacagtagaaaaagctgttttaggtggaaaagcaggagttttaggagcagcagctttagcaataactgaacaataataacaattttaagaaaagctacaacacgtagagaatatctataggtgttgtagctttatttttacaataaatatattattttaaataggtaattagaaaagtagtaaaagcaatagtattattaatgtagggtggggttaaattgatttatggaaataaaatatatttaagagaaatattaaaagaagatattgatgtagcttataatttatgctctgatagtgaagtattaaaatataatggtgatcaatatggagtattatcaaaaaaatatataattgagcatttaaaatatttaaacataccttcaagaagaaattatgtaattgtagataaacaaagcaatattgtaggcgtaataatatattctgaagataaatatgctagaaatgtatatagtattagcataactataggtaaaaaatattggcgtaaaggatatggaagtgatgcaatacatactattttagggtatttatttggaaaaataaaagctcataaagttgagttagaagttgtaagagaaaatgaagctgcaatattgtgttataaaaagtgtggatttatagaagaggggataagaaggagtaaatattattaccagggagaatatttagatactattataatggggctattaaaggaagaatataaatggtaaggagttgcatatgggaattagatttatttttggtagagctggttctggaaaaagttattattgtttaaatcaaataaagaaaaaattagaaaatgataaaaataataaattaatattacttgtaccagatcaatatacatttcaaactgaaaagaaattattagagtatataggagaaagagcattaattagagctgaagtattaagcttcaaaagaatggctacaagggtatttgatagatgtggtggcagggcaattaacgtaatagaggattcaggaaaaaatatgcttatttataagctattaaaggataaaggagaagaacttcaatattttaatagaattagtaagcagcaaggctttgttggaatagtatcaaagtcaataactgaatttaagaagtataatatttccgaggaaattttaagagaaaaagaattacaaatagataataaggatttaaaagaaaaggtaactgacttagcatctatttataaaacattcaatgaaaatcttcataaaggatatatagattcagaagatatattatctattttagcaaaaaagttaaaagaatgtgagctatataatgatgctgaaatatgggtagacgaatttacaacatttaccccacagcagttagaaattttaaaggtattagctaaacaatgtaagaatataaacattactttatgtagtgacggtcaaattcagtttactgaaggtgaaactgatatatttgacgtaataaaaaatacggaaaatagattattaaaaatgatgcaagaaaataatattgcatataaggagcctgttaacttaaataaagaaaatatatatagatttaaagaaagtaaagagttaggtcatatagaaaaatacttctttaactttccatttaaaatatataaggatgaatgtaaagatataagattatataaagctaataataattattctgaaatagagtgggtggctcaagatattttaagacttgttagagataagggttatagatataaggatatagctgttgtttgtagagaaatagatagttacgataagattacttcagttatatttaatgaatataatattccatattttcttgataagaaaagggagatattaagtaacccattagtagtactaataatatcagcattagaaatattaagtactaattggtcttatgaaagtgtatttaaatatgttaagagtgggcttgtaacattagaatcaacatatattgataaattagaaaattatattttagctaatgggattaagggttataagtggactcgtgatttaatatgtagtacagatgaagagttaactcaagaagaaattgaagtttttgagtatatggaagaagtcagaagaccaataattaatttatataataagataaaaggtgatgttacagtaaaaaaatattgtacagcattatatgaattcttattagagataaatgcttttgaaactatggataggtggcttgaaaactttagtacacaaggaatgcaagataagattaaggagtatacccaagtaccatctatagtaatggatatgttagatcaagctgtagaagtattaggtgatgaagaagttgatttaaagactttttcgaagatattaatatcaggatttgaagaaaaagaaattggtgtaattcctatggcattagatcaagtaaatataggtgatatagcaagaataaagggtagagatgtaaaggcgctttatatagttggcgctaatgatggggtattaccatcagctaataaggatgaaggtatattatctgatgaagatagacttgaattaaaacaattaggaattgaacttgctagcgatacaagaagccgaatatttgaagagcaatttatggtttatacagctttaactataccttcaaattatttaatggtaacttatccaatggcagattttgaaggaaagtccttaagaccatcaataataataccaagattaaaaaagattttacctagattacaagaagaaagtgaaatatttaataagaatttatttaacgataaatattataatataacagcaccaactccaacatttaatgaacttatagaagcgttaagaaaggaatatgaaaaggaggaaattgaccctcattgggtagaaacttttaagtggtttgaagaaagtgatgaatttaaggatagaactaaaattatctttaatggattaaattatactaatctagttgaaagaattccaagagaaaaaatgaagaagctttatagtaatgataatggaagattaatgtttagtgtttcaagaatagaaaaatatgcgcaatgtccttttagctattatgttcaatatggattaaaggctaaggatagaaaagtatatgaattttcagctccagacttaggttcatttatgcatgacatattagatcaatttacaaataaaataagaaaagaaaatatatcatggagcgatttaactaaggatagatgtagtgaaatagttaatgaattagttaatactaaacttaaaaatgagactaattctattttaaatagtaataagaagtatcaatatttctcagaaagatttaaaaaaactataagtaaatctgtaactgtaatatcagagcaaatgagaaaaggtgaatttgatatatttaagagtgaatttgattttggtgattttaaagattcagatccaataaaattagaattgccttctaaggagacagtttatttaaagggtagagttgatagaatagataaggttgaattaaatggagaaacttatataagaatagttgattacaagtcaggttcaaaaagttttgatttgaatgaattgtattatggattacaaattcagttattagtttatttagatgcaatactaaaaaactcagaacagattttaaaaactcaatgtatgcctggtggaatattatactttaaaatagataatccgataattaaatctaaaaaggcattaagtgaagaagaaatccagatagaagtattaaagaagttaaagatggatggattattattaaaaaatgtagagcttgtaaaagctatggataatgatatggaaacatactcattaataataccagctgcatttaagaaagatggagattttacaagtactagttcagtggtaacggaattacagtttgaattattaagaaattatgttaatgataaaatgattgaaatatgtgaagagatgcttagtggagaagttaaaatagaaccttgtaaatcttcaaaggtaacatattgtgattactgtgattattctgcaatttgtcaatttgatacttcgataagggataataagtataaaattatcttgaagaagaaaaaggatgatctatggaatgcaatggaaaacaaagtaaaagaggaggagagtaagtaaatatggcagaaactaaatggactaatgaacagcttcaagcaattgaaactagaagatgcaatttacttgtagcagccgccgcgggttcaggtaaaacagctgttttagttgaaagaattataagaataataaccaatgaagaaaatccagtagatattgataagcttttggttgttacttttactagtgcagcagcttcggagatgagagaaagaatagcagctgctatatcgaaagctttagagaagactcctaactctaaaaatcttcaaagacagcttactttattgggaagagctaatataactactatgcattctttttgtttagatgtaattaaaaattatttttatactattgatttggatcctagctttagaatcggggatgagacagaagcaacattaatgaaaaatgaaataatagaagagctttttgaagagtattatgaagaggataatgaagaatttaaggagttaatagaagcatatagtggcgctaaagatgatgaaaaattaaaagaaatgatactttctttatatagattttctatgagcggaccttggcctgggaaatggttgattgaaaaagcagaagcttttaatattactactttagaagaacttgataaaagtgaatgggtaaaggtattaaaagatagcttaagagtagaattaaatggattcttaaatatgtataagaaggcaattgagataattaaggatactgatggattagagccatatttagatgcttttaatagtgattatggatatttagaaagatcttatgaaagcttaaatggaagcttaaatgacatttatattgctttaaattctatttcatttattaagctaaagactattaagaagaatcaagtttcagatgaaaatgctcaaaattcagttaagggcataagagactcagttaagaaaaaaataaaatcattaattgaaaatacttttgaatttactccacaagaagctttagagggaataatggaagtgtatccttttatgaagactttagctactgtaactcttgagttctcaaagcgatttgatgaaaagaaaagagaaaaaaacatattagactttaatgacttagagcacctttgtttaaaaatattaattgatagggatgaaaataataatattgtaccttcaaaggttgcagaacattttatggagttctttgatgaagtattagtagatgaatatcaagattctaacaatgttcaagaaactataatagatttagtttcaagaagaaaattaaaagagtctaatgtatttatggttggtgatgttaaacaaagtatatatagatttaggcaggcaaaacctgaactgtttttagataaatataatagatattctttagagggtgaaagtaaggatagaaaaatccaattatataaaaactttagaagtaggcaagaggttatagaaggcgtaaactatatatttaaaatggttatgtctgaaactgttggtgaacttgaatatactgatgaagaggcattgaacttaggagcaagttttaaggatgtagatgatgaaatttcaatagtaggtggagaaattgaacttcatatattagataaatcaggtattgttaaggaagaagaaattgaagttgtagatgaagacaatgaaggtggaagtaaagaagaggaagaagatatagatgctattactcttgaagctaaaattgttgcaaaaagaataaaggaattatttgaatctaaagatggtaaaaagtttaaagtatttgataaagatactaatgaatatagagatgttagatataaggatatagttattcttttaagagcaacaaaaaattgggcagaaatatttttagatgaattaggttcagaaggtattccagtgtatgctgatacaggtagtggatattttgaatctattgaaattagaactataatgtcactattaaaaataattgataatccacttcaggatgtacctatgatagcaactttaagatcacctatagttggatttacggctgaggagttaagtgatttaaggctattaaataaggatttatatttttatgaaataataaaggaagtatgcgaagggaactatgaggttaataatgaattaaagtttaaatgtattaactttatagtggcattaactaagtggagagaaaaatctatttatactccaatagatgaatttatatggtatttatatatggatactgcattttatggatatgttggagcgatgcctaatggaaagcttagacaggcaaacttaaaaattcttttccaaagagcgaaacaatatgaaagcactagctttaaaggattatttaattttataaactttattaataagttaagaaaatcttctggtgatatgggaagtgcaaaggtacttggtgaaaatgaagatgtagtaagaattatgagtattcataaaagtaaaggcttagagttccccgtagtattcactagtggaatgggtaaacaatttaacttaatggatttatcaaattctattttatatcatgaagaattagggtttggtcctagttatgttaatttagaaactagaaattcatattcaacattagcaaaagaagctataaagaaaaggataagattagagactttatctgaagaaatgagaatactgtatgttgcatttactagagctaaagaaaagttaattattactggagcaactagtaatttagaaaaatcaattaataattggatatcttcagcttccttagatgaaaatatagtattgccttcagaagtcttaaaaggaaaatcatatttagattggattgctatggcaatgtgtaaacatacctgtggagaaaagttaagaggggttacgggtgctaccagagatttaattactagtgacttttccacatggaatatcaaattctggactaaagatttattaacagtggataaaaatttagagactgtggataaaattgaagaagatagcctgtttataacttctgaagatatagttgttgataaagaaataaagagaaggcttgattataaatataagtttatagagggagcaatgttaccgagtaatatttctgtatcagatttaaaaaagaaagaatttacttatggagatgaaatccatgatactgtagaagtatttaaagaaaaggaaattttaaaacctaaatttttaaaagaggaaaaaggattatcggcagctgaaagaggaactgtaattcactatgttatgcaaagattaaattatgatagagtaaatagtgattctgaaataaaggcccaaattgaagaaatggtattagataattcattaactgaaaaagaggcttctgttgtttggtataaaaaaatatataaattctttattagtccgttaggtgaaagattagtaaaatcttataaagaaggaagattggtaagtagggaattacctttctttactgaactaagtagcgtagaatataatacagaattaagtagagatgtttatattgatgaaaagattaggcttcaagggataatagattgtttctttgaagaagaggatggaatagtacttttagattataagactgattatgttgaagaaggtaatgaagatgagattattgaaagatatagagctcaacttaagtactataaaaatgctttagaaaaaataacagggaaaagagtaaaggaaagttatctttatttatttggaatagataaaggagttttagtaaaagaataattattaaatagataggctagcagaaaaatgatatgatcactttatggtagacagttaaaataataaagactgctacttgagagggagcatatcagaattttgctagcctttagtgcattatacattaaagaaagttttcagaaatttttaaaagactgtccttagtatttagagttttatcatctaaaactttttctaataaaaatattagtatttctccaataatttttccaggtttaatatttaaatgtgtcattaaatcagagccagtaacagctaagtctttgatataaagtggttctttatttttaagtattaattttactctatcagaaatataatctacttttttcaagaaaggaactggatcccataatgaatttatatcagctttttggagttcaaaaagtgtaaatatattttcactaccaacacgtattaataatcttttgatttcaccatcagtaggcatataattaacatctaaaactaagtgatcataaattattttagaaactttgtctatagtattattatcaaattttagcctagataatattggtttacatattattgcaccttcttgagcgtgaccagggaagtagcaatgaccattaggtaattgctttaatgtattaagcttaccaacatcatgaaaaagagctgataatcttaagattaaatcattatttgaagtattacttattacatttaaagtatgattaaaaacatctctattatgattattacaaagaggtgtataaccaaccaaattataaatttcaggaataattatttcaagaattccagtgtctttaagtaaattcaaaccatcacaaggattgtcggaaatcaggattttacataattcatctctaatacgctcaatactaatattttttattagtttataatttgattttatagctacatatgttgaatcatcaattttaaatcctaactgacagctaaatctaatagcacgcaacattcttaaagcatcttcttggaatcttttatttggatcgccaacagccttaattattttattttttatatcatctataccattaaaatagtctataaggccttctttattgttataagctaaagcattaactgtaaaatcacgccttgataaatcttcttttatgtttgaaacaaattcaacagactcgggatgacgattatctaaataatttccttctgttctgtaagtagtaacttctagattttcattatccaatacaacggtaattgtcccatgtttaattcccgttggtattgttttttcaaatagtgattctgttatgtttggtaaggcagaagtggttatatcataatccttaggtgttaagccaagtaagcaatctctaacacatccaccaaccataaaggcttcataattatttttataaaaagtatctataataaattgaacgttattaggtatattaataaacatattaaatcatcctttaaaataaattgttattaatatattttaacataaagatcattaaaaaaagataatagtaaaaaattaagaggtagaagttaactgaattagaatttaatttctacctcttaatacttatttaattattacttttgtacctgcttctatattgtcatatatccatttagcatcttcagtttttaatctaatacaaccatgagaagcaggagtacctaaagtgttatcaactacttcactttggtcttcattataaggaactgagtggaaaagataatctccataaaactgtacccagtacttaccaccttgtttgtatttatcagaaaagaaccaatcaccacgttcccttacatcataaacaccagtaggtgtattttcaccatctatgccagttgaacaattaaaggatttaattttatcccatttgttcattgagcctttataaacataagtaatttgatcagctaaactaacgtatattaaattagaagttaagctttcaagatttaatgtattaatattagagctagttattgaattaagcaactcactagatgttgatgttgaattttgtgtactatccgatgaacttaatgaagctaagtaactttctttagcctcagcaattgaagtaattttattttgaacatcagaatcatcttttgaaactatagaagtatcaatattatttaataaatctatagcttttgtatagtaatcattattagctaattcatctgcctcattgaatatattttctttatagttactaatacatttttctatatattcatttgctttttctgaatagtctgaatcagcagggattttctttagaaaattaagagcttcttcaaagttaccattatcacaattatctaatccaagagataaaagagcttcgtaatctgaagagtcttcagcttcataactttcatctaatgaaattataagcttatttatagatgaatttaagatatcataacttttaatttcattaagaactattaaagctttatctttattttcatcattttctgataatgtgtcacatatattattaactattccagaaaagtaagtatttaaatcagtatttagtgtttttttctttaattttaaatagatactattactatcaataagctttttggcatcagtaaaattacaattattaaattctgaataaaacgtacttgtaattgtggaatatttataattaacataatagtttaaagccaaaattaataataggaatgaaaaagtaatagtaacaattcgaaatatattcttttttttacgttttctaaataaattttgcaatgttatacctccttatagctattaataatatttgactaattttccaattttaaacctataattagtaaatttataaaaagtacataagaaaatattgaaaatatgttatacttaaaaagtataaaggtttgttaatttagaaggtttaatagaataaaggagcgataatttaaaaatgagaaataaatttatttttagcataaatcctaagaaatatgtttatttaaataaagaaaaattaagtaaaggttttttatatattttgttgttatctgtaattattggacttgttcaaggaataatgggagcagtgttaatatcaggattagaaaaaacaactaaaatgattttagaagaagatgaagtgcaatttgaaatgaaggatggaatattagattttaaaaattcacctttaaaagaagaagagggtcaggctttgttatacattgatacaaataaagatatagacgatttagattcactaagaagcattacagttcataaggatacagttactgtattactaaaagatggatttatggttaagagtggttcagaaagtgttactcaaaaatattctgatttagggttagatttaattaattttaataatgattttgttatatcagtcattgaaaaaattgatatagtaaaatatataataacacctatcatgatagtagttaaatttattcaattattaatgtatgcattatttatatcattaatagggatattaagtaatttaattttaaatagaaaaatgccttataatagagtatttaatttagcactatattcagttacattaccaacaataattaatataatattcccaataggagtatattcaattttaattggaggaatcatattaatgtttggattaagttttattaatgataattacttaaaacaaactattaatagggaataattgcaatattaattgttttatttcttgaaaaattaatttatttgtgttaacatagatttgttaacaccatggagcgttagttaaacggatataacacgccgctacggacggcgcattaagggttcgattcctttacgctctgccatgtaagaactgttgaatttcaacagttctttttttattgattaaatttcaatttgctaggaaaactaagaatatagtttgagtaaagaggtatcaaaaatatgattaatattttaataagtcaagttgatgaacataatgaaagtaatatattagcaacaaaagaatttaatccagaaaaagtctatcttattaaagataaatgctatgcagcaaaggctgaagcattaaaaatatattatgaaaaaaactttaaaaatgttaagttagaactttttgattttgaagaaggaaataaagaggctttagaaaaaataatagataatgtagaggacgaaaatataatagtaaatttaactggtggaaaaagagtaaattccttaattttattagatatttgcttaaaaaagaaaattaaagcagtatacattggtattaaagaaaagattatgtatgaatttgataataatgatgttttaagttcaaacaaaaactttgaagatttagaaattgacgatatagcaaaggcttcaggaggcatgattattgaagatgcttcacaactatgtaataaaaaagatttaatatatttttcagaacaaatatcaaagaatttaccattatggcatgaatataaacaaaaattatatgaagcaagtatatttgagcatgatgctaataatcagcaaagaatatatatacatacagataaattagatgaaaaagaaaaaaaattgttaaataaagtgttagaaaaacttaaagaaatgaaagaaataactctaaatgaaagtaataataaaattatagtagattttttaaataattatataaaagcatttatttttaagagtggtacatggttagaaatagaaactaataagcttattaataaaatagaagaaatagatgaatctaaaaatggtgttatgtttttatggaatgatgataataaaagtgttagaaatgaagtagacgtagtagcagtaaaagattctgtgcctatttttatttcttgcaaggatagtgataaatacaatgaaatggcactaaatgaattaaatgtttatgcttcaaaatttggtggcgaaaattcatataaattcttggtagcaacaaaagaaccaataaaatctccagtaagcataagagcaaaagaaatgggaatccacctaataatcttcgacggagacgaagataaatttatacgaacaattaaagctataatttagttgcagtacagtaaagcaaaaaaataaatagattatctccaggaattagtataattttcgataagaatttatatccttatttccgtaaaaactgctaaagcttcggatgtcgtttcactccctcagcttcttagcgcagtttttatttcaataaggattaaattctaaaactcaattataatattccttccgataatccatttattttttctttattaccacattccactaatttaagcctaagttgattctagttatttaactcttgtgctataaaatagtagtattgcaattcaagggataatttagtttgctatgggtatacagaaaaaaagaagatattatattgaaggcaatattgaaagcaagccgtagaatttaatagttactggagtaaagttcgcgttaagaagattatatgtttgagccgataggcgagtttataatctttagcaaactttatggaagtaactatataaattcaaggcgagatttcataaattcccgtaaagataatgtcttcttttttcgatattacacgtgataactaaatttttcaccaattttttctcccatgttgactttagtttcgaagccaaaggaagattgaagtaaaatgtcatcatctatagttactgtattctttttgaagaataaaattgttgttgatccaccaaatttgaagtagcatttttcatcacctttttttaccttttgattaggtgtatagctttggattatagaaccaacacaagtagcaccaacttcaacatgaattacatcaccgaagtttttagagtggaaaactgaccattcccttttattttgacaatataatttagggactcgctctaaagctgtaggattaacagaataataatttccgggaaccttatttgaagcttcaatagttccattatctataaaatgtaatctatgataatcagtagggcataatcttaaaactagacaaacacctccactatattcttttgcaatttcatcatcttgaattagttcagataagctataagtaattccttttacttgaattagttcatttatatcaatattagtataagccattaaacgtccatcgcctggagagattaatatatttttattagtattaatcggtcgtgcttctcttgtaagttttctaataaaaaaatcattaaaacttttaaaatcagcaggaatggttggacacatatccatatcaatattaaaacttgaaataaaagaagaaatttttttcctacttaatttactatcacaataaaatccgtatatttttgaaaatatccttcttttaataaataattctacaaatcctttgccgattggagattcatatgcccaattaatatatttttctccagctacagtttctgtatcatatttatttgttcttctattataaatttgtatcatgtaattacctcgtattattttttataattaataaaagactattaattatcataaagatatatttagttactattatataatatattaacatattttattttaatagtttattaacattaatataaagaaaaaatatttgaaataaaagatataaaataatagaataaacttataaaatatagttagtgatatggaggggtaaaatgagtttagaaataaaaatagtaaatgcaacaatagatatttttagagaaaaaggtgttaaatttactatggatgatttagctaatagacttggcgttagcaaacgtacattatatgaaaatatagatagtaaagaaatacttttaaatttactggtagatgaagtatttgattcagtaactgaaaaaggaaaagatgtaattaatgatgagagtattggaaatttagaaaaattaaaaaggatactgactattttaccaacatcttacgatactattgattatactaaaatacatgaagtaaaaaagttctatcctaaaatatatgaaaaaatcatatatagattagatttgacttgggaacaaacagatgaattagttaagaagtgtattaatgaaggattaattaaaaaagtgaatatatatcttatgaagagtatactaataggaagtataagaatcttattagaagataataaattaagagaagaaaaaatagattactctgaaacaatgaagagtattgtagatataatgtttgatggattagtaattaaataaataaaaagtcataataaaggagcctgtaatctagactccaatataatgacttttttattattcagcgaatttttctaagaattcatcgtaagacattgatctatctaaaatagaaccatcatcacttattcttatgattctatttgcaactgtttgaacgaattggtggtcgtgagaagcaaataaaacattactgctataatcctttaatccattattaacagctgtaattgattcaaggtctaagtggttagtaggtccatctaaaattaatacatttgcactagaaagcatcattctagaaagcatacatctaaccttttctcctccagataatacattagcttcttttaaggcttcttctccagagaataacattcttcctaagaatcctctaatataactttcagatttttcttcagagaattgtcttaaccagtcaactaagcttaatgagcaatcattaaagaattcagagttatcttttgggaagtaagcagtagttatagtgataccccatttgaattcaccagcatctggttccatttctccgtttattattttaaataaagtagtgattgcaatttcattaccaacaaaagcaattttatcttctttatttactctgaagcttacgttatctaaaactttaactccatcaatagtcttagataatccttcaactactaatatatcattaccaacttctctttcaggtttaaatccaacgaatggatatcttctgcttgatggttgaatatcatctaaagtaattttatctaataacttcttacgagatgttgcttgcttagatttagaagcattagcactaaatcttgcgatgaagtcttgtaattctttaattttttcttcttttttcttattttgatctttagccatttgagtagctaattggcttgattcataccagaagtcatagttaccaacatataatttaatcttaccaaagtcaacatcagccatgtgagtacaaacttcatttaagaaatgtctatcatgtgatacaactataactgttccttcaaagtcacctaagaagttttgaagccatttaattgattttatatctaagtggttagtaggctcatctaggattaatattccagggttaccgaataaagcttgagcaagtaatactttaaccttttctgcacctgttaattcagacattaatttgtagtgagcatcagttccgattcctaaaccttgtaataaagatgatgcttctgactcagcttcccatccatttaattcagcaaattcaccttctaattcagctgctttaattccgtcttcatctgaaaagtctggttttgcatataattcatctttttctttcattatagtatgtaatctttcattacccattataaccgtttctaaaactgggaattcatcatacttataatggtcctgacttaaaacagacattcttgtatttggagcaattataacttcaccagtgtttggttcaacttctccagataatatttttaaaaatgtagattttccagccccgttagcaccaataacaccatagcagttaccaggagtaaatttaatattaacatcttcaaataatttacgagacccgtatcttaaacttacatttaaaacattaatcactcaacatacctcatttcatttattattctttcgatattataacataaaaattttaactttgtattaaaatatacaataaataaactagtgaattggtgagaaatctgcaaaaaaaatcattgtaaaaattttatatgcaaaaaatgatttattaacataaaaaagaagcacaaattaagtatgtaaaaataaagaaaaaagctgatatataatcagcttttaagtatttatttgataaatatattaattatgcaaataagattattatttttctttataaaaagtatttatttaagtcttcaaaagtttttatattaaatatatttaaagcaatattaataacgtcattgttttctaaggattctaatttatcaatatatttttctgaaagtgttcctaatctttttgttaacagttgcattaataataaatgttgaccacgctctattccggcttcaacgccttcttcgtaagaaccaaaattaaacatataatataaacctctcttataaaattatattacataagtaaagacacaaataaagtgacttaaactgcctagtaatatgaagatatggaatatttcatgaaatctccatttgccaattcttaatttttctggtttaattccataaattacgccaccaattgtataaagaacaccaccaagtactagccaaaataagcttattccaggtaatactgctgttaatggtttaatcatgaataaagcagcccaacccattcctatatacattgcagtttgaagccatctagggcaatcaaaccagcaaagtttaaatgtaataccaagcacagctatagtaatcattactataaacattgtaagcccgagttcaccgcctatagaaattaagcaaaatggagcatatgaaccagcaattaaaacaaaaatcattgagtgatctagtttttgaaatattgaaataactttttcacttgaagttattccatgatacgttccagaagttgtatataaaagaattaaactaattccaaaaataactacagataagatggcagtacttgatggattagatgagattaccttagctagcatagcaaataaagcaattagtgataatccagcaccaacaagatgagttatagcattaataggttcccttaattttttgtacatataaaaaaacacctctcaattcgacatgtggtttttaaaactacatgatattatattaatattatttattatatgtgcattatagtcaaagtttattttaggagatttaaggaaattatcagtaaatacatctgtttttcttgcaaatattagaaaatactattattattaaaatatagtagtgataataagtagttttcaaaactatatggaggatgttatggatataatagaaatattaaataatttaccgttagaaagtaatattaggttagatgaagtacctgaaatagatttatatatggatcaagtaattcaattgtttgaatctaaattgaataaccaaaaaagaaataatgatgaaaaaatattaacaaagacaatgattaataattatgctaagggaaagctattattaccaataaagaataagaagtattcaaaagaacatattatattaatgtctttaatttataatttaaaaggagctttatcaataaatgatattaagagttcgttagataaaataataagtaaatcagaagaagacaattatccattaagagaattatattcgagctttttagaagagtgttctaatgatgaaaataattttaaaagggatgtaacaacaaagtttgaagatataagcaatatagttgatagaaatgaaaagttagacggggattttgaaaagaaatttttagtgttatgttctttagtaaatatgagtaatatgtatagaagaatgagcgaaaaattaattgatgaattttttactgaacaggagtaatatatgagaaattcaagtgatttaaaaaaagaattagatagaattgatggccgtggctataaatcctataaagatttagaggggcaatatagttttaataattatatattgagtatagaccatgttcagggagatccatttgcatcaccatcaagagtaagagttatagtaaatgccaattataatcaacttcctgaagaattatttgatgaaaaatataagaaggtagcattatgtgactttttaactagattatttagtaaaaatatttataaatatggagagaaaatctttggatcaggaaaaagtggacttatagaaataagtagatgtccacagcaaatattggaaagaacttcagtaataatagataatgaaaaagtagaggcaagattttatgttggattccctgctaggggaagaagtgtattatcaagagaattagaaaagatattatttaatgttttgcctaatatagttgaaaatacattgatttataataaaataaacactaaggctttaaatgatagaataaaattagttgaggatcaagaatttataagaaatgaacttaaaaataaaaatcttgttgcgtttgttgctaataattctatattaccaagagaaagtggagtctcacaaaaacctttgaaagatgggaaaaagtttatttctcctaaagaattggaagtagaatttaatacacctaatagaggagtaattaaaggaatggggataccaaagggaataactttaatagttggaggaggatatcatggtaaatcaacattgcttagagcattagagcttggtgtatataatcatatagaaggtgatggtagggaatttgttattacagatgatagtgcattaaaggttagagctgaggatggaagatcgataactaaaacagatatatcattattcataaataatctacctaatggaaaagatactaagaaattttatactgaaaatgcaagtggaagtacatcacaagctgcaaatataattgaaggtattgaaagtggaacaaagctatttttaattgatgaagatacatcagcaactaatttcatgattagggatagaataatgcaacaacttgtagctaaggataaagagccaataaccccctttattgatgtagcaaggagtctttataaagagagaggaatatctactatattagtggcaggaagctctggggacttttttgatattgcagatttagttattcaaatggataattatgagccgtttgaggttactgaaagggctaaagctttaagtaaggggttagttgagtataataaagatttaaatattgatattaattttaatagggtaattcttaaaggaacaatagaaagtggtcctaaaggcgtaaagataaaaacattaggtaaggatggaatttctattaatagagaaaacatagatttacgtagtgttgagcaaatagtagatagtgaacagttaaatactattggggctgttatgaaatatgttgaaaataaattaatgggaaaggatttaacattaattgaaataacagataaggtaatcgaagaattaaataagaatcttattaatattgataatattaaaggtggatatgggagctttgcaatggtaagaaagcaagaaattatatgtgcatttaatagatatagaaaaataagaataaaataatttgaataaatggaaaaaatatctagaatatttttgagatatatggtaatattaatattgttaagttaataattaacaatatggcttgttggtcaagaggttaagacgtcaccctctcacggtgaaatcaggggttcgattcccctacgagtcaccattatcaaggattagggagttaaacaattttgtttgctcctttttttatataaaaaaaagctaccataatggtagcttaaatatttaatatataaaatttgctattagaactataactggtaaagttattaatgttctttctataaatattataattaattcttttatgtttatgggaattttagaaccaagtaaaactcctccaacttcagacatatatacaagttgagttacagaaactgcagcaactataaatcttgtcatttcactagttattgttgttgaagcaacaactgaaggaagtaacatatctgcaaatccaacaactaatgtttgagaagcttgaacggcttctggtacttgtaataattgaagtattggaataaatggtattccaagaattttaaatagtggcgtgtaagtagctattataagagctagtgttgccatacacataacaacaggaagaactccaacccacatatctaaaacattcttagcaccatcagcaaagaattcttttacactagaattctttcttgcttttattatagcttgttcatatccccatgataaagaagtatatccttgaggaatagattcgtctatttttttagtttcaccattataatatgtatctttcttttttgataaaggataaattcttggtactatcacagctacaactattccggccaacgtaacagttaaataaaatggtataaacatatttccaagtccaacagtatttattacaactaagctaaaggtaattgaaactgcagagaatgtagtacttatagttgcagcttctctttcagtataaaatccatcttcatattgcttattagttagcattatccctaaagtaccgtcacctagccaagaagtaatacagtcaattgaagaacgaccaggtaatttaaatacaggtctcattactttagttaataatgaaccaaagaattctaataaaccaaagttaagtaataatggtaagaataatcctgcaaataggaatatagaaaataatactgttaaaagatcatgtaatacaaaagcaccagtatcaccacttattatcatttcaggtcctatctcgaatgctgcaagaacgccaaatataccacctaatactctagcgactaaccatattggtgtagtggtaaataatgagcttaaaagcttattattagtaatgaatttaggtttaacaaatgttgctattaagctaagaattgctgaaatagccattgtacctgtaattatatatactaaatattcaccaagaaaatttactaacattccagaaaaaatagctacaggaattgttacatcaccttcatgttttattggaatcataaataataaaacaccaattatagaaggtatgataaattttaagttatcttttaaagtaactttatttttattatcatcaaatggttttagttttgaaatttccattctgtctcctttatacataaaaaatttataattattcatctatattcattttaaatgtagaaatattaaaaatcaatatttttcatgcataaaaactaaaaaaaacattggaaaatttaatttttatgcaaatatattaaaatttatgtgttttttattcaagtttatagaaagtaattatttaataaggaagataaggtcataaatgtaaaggaagtttttatagtaaataataataaagataattataataaagagataacaatctaagtttcaggagatgattaaggtgaattatagagaacaaatgaaagaatgtaatagaatagtaattaaggttggaacttcaacacttacttatgataatggaaatataaacttaacaagaatagaaaagttaacaagggtaatatcagatttaatgaattcaggaaaagaagttgtgttagttacatcaggagcagttggggttggtgttaacaagcttaaattaaaagaaaaaccaaagagcataaaagaaaaacaagcggtagctgcagtagggcaatgtgagcttatgcatatatatagtaagttttttggagaatatagtcatgtcgttggacaagtattactaacaagagatgtcgtagaagatgagcatataagagaaaatgttgttaatacatttgaaactttattagaaaatgggataataccaatagttaatgaaaatgatactgttgccatagatgaaatagaaaacatagttagatttggagacaatgataatttatctgcaatagttgctcaattagtttgtgcagacttactaattatattatctgacatagatgggttttatgattcagatccaaggaagaatccaaactcgcagcttataaaaacagtaaaagaaattactccagaactagaagcatgtgcaggtggagcaggaagctcacttggaactggaggaatggctacaaagttaacagcggctaaaagagctataaatgctgggtgtaatatggtattagccaatggtgatattccatcaatattaatggatataatagaaggtaaagaaattggaacattatttgtaaagaaataaaaatgtagagaggggttaagtaataatgaatgaattaattattaaaggaaaaaaagctaaagaagtttcttttatattaggaaatttaagtacaggagaaaaaaatagtggattaaatgctatggctgattttttagttaataataaggaagaaattattaatgctaataaattagacttacaagcagctattgaaaatggtacatctaaatctatgcttgatagactagctttaagtgaagaaagaatagaaggaatggcaaatggattaagacaagtttctgcacttccagatccagttggagaagttttaggaatgtggactagacctaatggattacaaataggtcaaaaaagagttcctttaggtgttataggaataatatatgaggcaagaccaaatgtaacaagtgatgcagctggattatgctttaaggctggtaatgtagctatcttaagaggcggaagtgaggctattaactctaataaggctatagttaaggttttaagagaaggacttaaatctataaatcttccagaggatgcaattcaattagtagaagatactagcagagaagttgcaactgaaatgatgaaattaaaagaatatatagatgttttaatcccaagaggaggagcagggcttattcaagcagtagtcagaaatgcaactgtaccagtaattgaaactggaacgggtaattgtcatatatatgttgatgaatttgcagattttgaaatggctaaaaatattgtattaaatgcaaagacttcaagaccatctgtatgtaatgcagctgaaaaattattagttcataaaaaaatagctaatgagtttatgccagttattttaaaagcattaaaagataaagatgtggaggttagaggtgatgaaacttctatggcttacgattcttcaataataaaggctaatgatgaagaatggtatagcgaatatttagattataaaattggagtcaaagtagtaaagaatatagatgaagcaataaatttaattaatcattttggttcagggcattcagaagctataattactaaagattatgcaaactcacaaaaattcttacaaaaggtagatgcagcagctgtttatgtaaatgcatcaactagatttacagatggagaagagtttggatttggagcagaaataggaataagtacacaaaagcttcatgcaagaggtccaatgggacttaaagaacttacaactataaaatacattatctacggaaacggacagataagataagtgagcctccaaatttcaatttggcaaggcgaacttactcagccgacagaaggaggcagagtttcaataaacgcctccaaattttaatttggcaagacgaacttactcagccgacagaaggaggcagagtttcatctgtgatatttcacttaaaatatgtagaaagccagttatctagcagttttatataaaaaataatgtacaaattttaaaataaacacatatcatatagtagaagaaatagtcgagaaggaataatatatggcctatgtattgattttttgtttaatagtagcgctaattgttcttagcatatttgtagtaatggacatgtatggcaataagtacattttagacatgaaagaccttccgatagattgtgatactgtaattattttaggtgctggtataagaccagatggaaatccttgtgacttattggcagataggttagatacgggtgctaaagtatatgtaagaagaatatgcaaaactattttgttaactggtgataatagtggtgagaatcataatgaacttgctgttatgaaaaattggattatgaaaaactacactgaagagaatattagagaatcagatttattaatagataattgtggcttttgtacttatgatagtatgaagagggcgaagaatatatttaatattaataaagctataatatcaactaatggatatcatttgccaagagccatatttattgcaagaagatttggaattgaagcatatggaatagcctctgatatgagggaatacgatagaatgaagaaatataagagaagagagcgtttggctcaaattaaagatttctttttatgccttataaagatatattaatgtatctttataaggccttcttttattgataaataaaaataaattatatttttaatagattatacttaaattatattggataataaatagataaaatagtagcaaaaaaagggaaggaagtagaaaaatgtttgaaattaaaaagtttaatgatttaacggttaatgaaatgtatgaaattgcaaaatctaggtttgaggtttttgtttgtgagcagaagatagtagaagaacaggattttgatgataaagataaggtatgtcatcatataatgttaaaagaaaatgaaagagttgttgcttattgtagaatagtacctaaaggaataggatacgattatatttcagtaggaagagttttagtactttcaagttatagaggaaaaggaattgctcaagaaatgatgaaagtggcattagagtttattaaaaacaaattagatgaaaaaactgtagtattatcagcacaactttatgctaaaggattatatgaaagtgtaggatttaaggttatatcagatgtttatgatgaagttaatattcctcatgttaaaatgaaattagaattataagatttttaggagaggtttattatgaatagtacaagaaactatacattaataacaggtgcatcaactggaattggatatgagcttgcaaagttatttgcaaaggataaacataatttaattttagttgctagaaatgaaaataaattacaagcagcaaaaaatgaattaattaaatataatgtgcaagtaaaaatattaagcttagatttatcaaaaaatgaggatattcaaggtttatttaattatgtcgaaataaataggttaaatgtagatattttagttaataatgctggaattggaacctttggtgattttaatgaaatagaatgggcaatggaagaagcattaatagatataaatataaaaacattaactaagttaacaaaatatttcttgcctaagatcattgaatgtaaaaatggaggacttttaaatgtagcttcaacagctgctttttgctcaggccctagaatggcagcttattacgcatcaaaggcatatgtacttaatttaacagaagctatatatgaagagtgtaaagatagtggaataaagatttcatgtctttgtcctggtcctgttaagactactttccaagacaaggctggaattaagaaaagtgaatctgccaagaaatatttaatggatgcagaaaaggttgctaaagtttgctataaagattttaaaaaaggtaatcttattataattcctggaatgaaaaataaattattagttatgggaaataagcttttacctagacgaatctcaagaaaaataatactgaaaactaataaaaaataaggagaaaaatatggggatttttgatggatatttattagtttctgatatggatggaacacttttaaatagtaaaggaaaattatcagaagaaaataaaaaagctatagagtattttgtagataatggtggtcaatttactttagctactggacgtatgttaccttcaataaagagacatattcataagatgaaggttacacttcctgtaattatgtataatggaactaaagtatatgattttaatagtgatgaagtaatttgggagaagtttttagaagaagaacgaaaagaaatagtcaaagtaataaataaggttaatcctaatataggaatagagatatatagtaatgagcaagtatatatttatcaagcatgtaaaagaactgaaagatttagtaagctaggttatgatgtaatttataatgtcgatgaaagtatttggaataaaaaatggactaaagctttaattgtaggtgaaaaagaagaactagattttgttgaaacatatttaagaaaagactatggtgataataatattgtaaggagttcagatgtatatttagaaataataccaaaagaaatatcaaaggggcaagcattgaagaaattagtaatgtataaagaaattgaagattttacgataattacggttggagataatatgaatgatgttgaacttttacaagaagcggagtatggtttttgtataagcaatggaagtgaagaattaaaaagaaaatcaaaatatatagcaccaagtaatgatgaaaatccaatagaatttatagtaaactggataaaagaattaaaaaataaataagtttaagaaaataaagccattaagataacaaatctaatggctttatttcatatatttataaaaatacaactatattgaataaatattcataaagaggtataattataaaaaatgcacattgaaatatttggaataaagtgtacaaaaatttagctggcaaattccacctaataaagctaatttattcttgacaataattcgcgctaaatatacaataatatacaaagataagaataaataattaattagttaaaaagtacactttaaattggtccagagaggccagaaaggagtatgtaggtatgttatatgtaaatagcaatagttacatcgatttatcaaaagaattttctaaagtaaattttaaatataataaggatagtatggagagattacatagttaaatgtctccttactatccttttctgttatttttaactaaataaatagttaagaaaatagataaattatatttaaagttaaagagcttttagaaagtgtatttttagctgttatatacatgaattttaggagggctaggaatgaaagcaaggcttatattagaaaatggcatgatttttgaaggtaatgcatttggatacttaaaagatagcgtaggagaggttgtatttacaacaggaatgacaggatatcaagaggttttaacagatccatcatactacggacaaattgtaactatgacatatccactaataggaaactatggaataaatttagaggataatgaatcagatacacctaaggtaagaggattcatagtgagagaaaaatgtagcttcccaaataactttagatgtgaaattggattagaagattacttaaagcaaaataaaataataggtttagaaggtatagatacaagagctttaacgaaggtattaagaaacaatgggacaatgagaggaataatttcattagaacatgaaacattagaagaagttaaagaaaaaataagtgctttttcaaatagagatgcagtaaaaatggtaactacaaagaaaccatatacaatcgagggaacaggaaagcatgttgcaattatggattttggaataaaaacaaatataataagaaacttcaaaaagagaaattgcaaaataacagtatttccaatgactgctacagcagaagaagtattatcagtaaatcctgatttagtatttttatcaaatggccctggggatccagaagatttaactgatgtaatagaaaacattaaaaagatagttggagttaaacctatagtaggtatttgtttaggacatcaattactagcattaactttaggtggaaaaactactaaattaaagtttggacatagaggatgcaaccatccagtaaaagatttagaaagaaatagagttcatattacttctcaaaatcatggatatgtagtagatgagctaccagaaggtgttatagcaacacacttaaatattaatgacggaacagtggaaggtatgaaacatgctactttaccaatatactcagttcaattccatccagaggctgcagcaggtccaaaggatagtgaatatatatttgacagatttatggaatatgcactataggagggtttagaaaatgccattaaataaagatataaaaaaagttttagttataggatcaggaccaatagttatcgggcaagctgcagagtttgattattcaggaactcaagcatgtcaagcattaaaggaagaagggatagaagttgtattagtaaactctaacccagctactattatgacagacaaagaagttgcagataaaatttatatagaaccattaacattagaatttgttgaaaaagtaatagcaaaggaaagaccagatagtttacttgctggtatgggaggtcaaacaggacttaacttagcagttgatttacatgatgctggaatattagaaaagtataatgttaaagttataggaacttcaatagcttctatcaaagaaggtgaagatagagagctatttagagatatgatgaatagaatcaatgagccggttattacatctgaaatagtaactgatatggaagctggtatggcatttgcaagcaagattggttacccagttatagtaagacctgcttatacattaggaggaactggtggaggaatagctgaaaatgaagaggaattaagaactattcttgcatcaggattacaattaagtacaataggtcaagttttattagaaaaatcagttaaaggttggaaggaagtagagtacgaagtaatgagagactcttacggaaactgtataactgtttgtaacatggaaaacattgacccagtaggtattcatacaggtgatagtatagttgtagcaccatctcaaactttatctgataaagaataccaaatgcttagaactgcatcaatcaatatcataaatgcagtaggtattgaaggaggatgtaacgtacaatttgctttaaatccaaattcatttgaatatgcagttatcgaaattaaccctagagtttcaagatcttcagctttagcatcaaaagctactggatatccaatagcaaagcttgcagctaaaatagctttaggttacggattagatgaaattaaaaatgcagtaactcaaaagacatatgcttgctttgaaccaacattagattatgttgtagttaagattccaaaatggcctttcgataagttctttacagctgatagagctttgggaacaaagatgatggcaactggagaaataatggctataggtgctaacttagagtcagcgttattaaagggtatcagaagtttagaaataggaaaatattctttagaccatccaaagtttaaagaaatgagcatacaagaattaaaagaagctgtaatgaaaccagatgatgaaagattatttgctcttacagaaatgataagaagagattatagaattgaaagcatagctaaaattacaggaatagatatattcttcttggaaaaattcaaatggatagtgcatgaagaaactagattaaaattaagcaaaatcgatgatttagataaggaatggttattaaaacttaagagaaaagggttctcagataaggctatagctgatatgttaaaggttagtccagatgatatctatagattaagaagtatctggaacataaaacctgcttacaagatggttgatacttgtggtggagaattcgaagcattatcaccatattactactcaacttatgaacaatatgatgaagttgaagtatcagataagaagaagattatagtaattggttcaggaccaataagaataggtcaaggtattgaatttgactatgcctcagttcactgtgtaatggcattgaagaaaatgggaattgaaactataatagttaacaataatccagaaacagtaagtactgatttcaatatatcagataaactttattttgaaccattaacagaagaagatgtattaaacataattgaaaaagaaaatccatatggagttatacttcaatttggtggtcaaacagcaattaagcttgcaaacttcttaaaggaaaagggaataaagactttaggaactacagcagatcaaattgatatggctgaagatagagaaaagtttgaagaattacttgaaaagtttgatatagctagaccaaagggtaaaggggtttggactttagaagaaggtatagaagaagcaaatagactaaaatatccagtacttgttagaccttcatatgtattaggtggtcaaggtatggaaataactcatgatgaagaagagttaacttactacttaagcaatgcatttaaaaaggataagaaaaatccaatacttatagataaatacttaatgggtagagaaatcgaagtagatgctatatctgatggagaaaatattttaataccaggtataatggaacacttagaaagagctggagttcattcaggagattccgtaacaatgtatccaagtcaaaatattagtgatgaaattaaagcaaaagttttagattacactaagaaattagctttagctataggaattaagggaatgataaacattcaattcatagagttcgaaggaaatctttatgtaattgaagttaatccaagagcttcaagaacagttccatatatcagtaaggtaagtggagtaccaatagtagatttagctactaaggttatgcttggagaaaaattagttgacttaggatatggagtagatgtttatccagaaccagaactagtatcagttaaggttccagtattctcaactcaaaagttgccaaaggttgaggtatctttagggcctgaaatgaaatctactggagaagttttaggtgtaggtagagatgttaaggaagctttatataaggggtttgttggtggtggaatgtatccatcaatggaaaaaggaaaaattttagcaactatcaataaacatgataaggctgaattcttaccaatagctatggatttagctaaggctggatacaattttattgcaacagaaggaacttgcaatcttttaagagaggcaggaattgactgtgagcaagttagaaggcttaatgaagatgcaccaaacatattagatgttgtaaaaagtaaaagtgttgatttagttgtaaatacgccaactaagggtaatgactctaagagagatggattcttaattagaagagctgccatagaaagaaatataggagttatcacagctttagatacattaagagcaattgctgatgttaaggtatgtgaaattgataagagagatttagaagtattcaatatagctgaataataaaaaaggaacaggaaaatattaaaatggaccctatatagtagacactcaaaaaaagagtatctatctatatagagactctcaaaagaattgctggtttactttaactatattctgttcaattttcaaagaccattttcttcatcgctctcaagcgacttctttatcttatcactactctttttccttgtcaacaacttttttaaaaaaagtttttttgacatttctttaagtaatgaatcatttcttgtcacttcaaaattaacttattcaacaactttcgtttgttttgttaatttgtcatcagcgacgtgttttatcttaacatcaacactaatattaatccctcattttcatccgtttatattaaattatactcaatattctcttattttattaaaaatactccatttttctattattgatacactaggcacagagtacatatattttttatgttttgtttctatatttatataaaaaaagtgataaatcacttaatacaactgtattatttgcaatttaccacttattataactaaatattttttattcttctatatcttctctttgagcctcttctactaatctatctaaactagtatcattattttcttcaactaattcattatccgcacatgcttctaatgttaattgttcatcactttcttcatgtccagtacttgctatcttagcaacagcaaccactttttcctcttcagtagttctcattaaagtaactcccatagcagatctactagttactgagatatcagatacatttattctaattgcaattccacttgtatttataagcattaattcatcttctggcttacaaacagtagcacctacaactttaccagtcttttcacttatcttataagtaataagacctactccacctctattttgtctcttatattcagttaatggagttctcttcccaaatccattttcactaattactaataaatcttcctcatcaactgctatatccatacaaacggctatatcattttctcttaagttcatagacttaactcctgatgccgttcttcccataggccttacatcttgttcattgaacttgattgcattaccatcctgagaaactattataatatcggcatctcctcttgtaaccttaaccttaagaagttcatcaccatctcttaagttaatagctattagcccactctttcttaagttcttaaattctgataaaggtgttttcttaactaatccatgtttagttgccatgaataagtatcccccatcaatattatctctaacagttaatacagtttctattttttcatcttgctctatttgaataagatttattatattagttccctttgctgttcttccagcatccggaatttcatatgctctcttcttatatactctacctctattagtaaagaataatacatctgaatgagtcgaagtaactaaaacatgttctacgaaatcatcttcttttgtagacattgcttgaatacctcttccccctcttctttgagcagaatatgtatcagctgatattctcttaatatatcctgaattagttaatgtaataacagtttcttcttcttgaattaagtcttctatatcaatatcattaacaactttctctatttgagtccttctttcatcgttatatcttgactttatttcaagtagttcatccttaattacagctaataatctttcttcacttgcaagaattgagtttaagtaatcaataagtttcattagctccgcatactcttcttcaattttatctctttctaaacctgttaatcttcttaatctcatttccaagatagcaatagcttgtttttcagataatccaaatcttgcaattaatgtattcttagctatttcacctgtttttgatcctctaataatattaattacttcatcaatattatctaaggctattcttaatccttcaagaatatgagctctcgcttgtgctttttctaattcaaatattgttcttcttgtaacaacttctttttggaaattaatataattacttaatatttcttttaaatttaaaaccttaggctcattatttactaaagctaacataatgataccaaatgtatcttgcatctttgtatgcttaaataatagatttaaaacaacatttggatttgcatccctctttaactctattactattctcataccttctctatcagactcatctcttaagtctgatattcccacaatctttttgtccttaactaaatcagcaatattttctataagcttagctttattaacttggtatggaatttctgtaactactattttatgtcttccattttcctcttcaatttcagttttagatctaactacaattttaccttttccagtttcatatgcagctcttatacctgatttacccattattattccacctgttggaaaatcaggtccctttatacatgtcataatatctaatcctgtagcttctggattatctattaacattatagttccatcgataacttcacctaagttatgaggcgggatattcgttgccataccaactgctatacctgaagatccattaactaaaaggtttggatatcttgaaggtaatactactggttcttgttcttcaccatcaaagttcggcataaaatcaacagtattcttattaatatctctaagcatttcaattgcaattttattcattttagcttctgtatatctcattgccgctgcactgtcaccgtcaacagaaccgaagttaccgtgaccatcaacaagcatatatctcattgagaaatcttgagccattcttactaatgcatcatatactgatgtatcaccatgtggatgatacttacctaaaacttcaccaactattctggcacattttctgtatcccttattaggctctaagcctaattcttgcattgcataaagaattcttctatgaactggtttaagaccatctcttacgtctggaagagcacgcccaacaattacactcatagcgtaatctatatagcattgcttcatttccttatttatatctacatgtataaattttccctcatttaagttcatttactcacctcgactaatactaatttcttagtattaaatatctaaattgcttattttactagcatttttttgaatgaattctcttcttggttcaactttatctcccattaatatagtaaatatctcatctgcagcaattgcatcactaacagatgcctttttaaggattctatgttctgggtccattgttgtatcccataattgattagcattcatttctccaagacctttgtatctttgaatatttattgagctatcttttccaccaaactcttctaaaatcttatcaagatcttcctctgtataagcatactcttctcttttacctttgctaactttatataatggtggttgtgctatataaacatggcctccatctataagcggtctcatatatctatagaagaatgttaataatagagttcttatatgagccccatcaacatcggcatcggtcattattattattctattatatcttaatttggcttcatcaaaatcttttccaattcctgcaccaaaagcagtaatcatagctctaattgtatctgaattaagtattctatctaatctttgtttttcaacatttaatattttacctcttaaaggtaaaatagcttggaactttctatttcttccttgctttgctgaaccaccagctgaatccccttcgactatataaatttcacattccattggatccttagatgaacaatctgctaatttacctggaagcgtagatctttcaagaactgactttctagtaagctctctagcttttctagctgcgtctctagctcttgctgccattaatgctttatctattataatcttacctactgcaggattttcctctaagaaaatacttactccttcagcaactattgaatcaacaacacctctaacttctgaatttcctaacttagttttagtttgcccttcaaattgaggttcagatatcttaacagaaacaacagctgtaagaccttctcttgcatcatcaccagatagatttttgtcattatctttaatatgcccaaatctcttagcataatcgtttattgctcttgttaaggcacttttaaatccagctaaatgagttcccccttctatagtatctatattgttagcaaaagaatatagattttcattatatccatcgttatattgaagagcaatttcagctattattccatctttttcaccttcaacataaataggagactcatgtaatacttctttatttctatttaagtaagaaacgaattctttaataccaccttcatagtggaatttttcaactctttcttcaccatctcttttatcaattaaagaaattgcaattcctttgttaaggaaagctaattctcttagtctgcttgctaatacttcaaaatcaaatacagtatcttcaaaaatttcatgatctggtttaaataataccttagttccatgttcatcggattctccaatcttcgttaaatcacataaaacatttcctcttgagtatttttgttgccatatgaaaccttctctttttactgtaacttcgcagtattcagataatgcattaactactgaagcaccaactccatgaagaccaccagatactttatatccaccgcctccaaactttcctccagcatgtaaaacagtcattataacttcaactgtagccttacccattttagggtgaattccaactggcatacctctaccatcatcaactacagtaattgaattatcttcatttattgtaacctctatatttttacagaacccagctaatgcctcatctatactgttatcaactatttcatatactaaatgatgaagacctctagaactcgtgctacctatgtacataccaggtctttttcttacagcttctaagccttctaaaacctgaatctgactttcatcataactttgcttattctcttccaacataaattcctccttatacttttgattttattaactatgaaggctaaatattggacttatggattataatcaatatttgttctcttagttaaagtagacgatgaaataggtgataaatacaccttactcattttattaacttccgctataacaaatgatttaggactttcctttgaaattatttcaacaaatccgtcttcttcagccattctcaaaaatgatattgtatctgaactatacattgatgtttgtaagtcaaatataccaattacatcttttattggtactactacgttttcccctaagtgtaaaaacataagaactcctcctttagttaagaatttctccatccttaactttaaaaactttagatttatcatctaaatactcatataaatcttcaattccagtacatgtaataattgtttggatatctcctatcgtacttaatatatatctcttcctactaaaatctaattcagaaagcacatcatctaaaagcaaaacaggatgttctcctgtaagctctttaatgatttttaaagatgcaaatttaatagttaaaacagcagtcctttgttgcccttgagacccatagctttttgtgtcaatatcattaattaagactataaaatcgtccctatgtggtcctacagaggtaattcctctctcgctatccctaactctattcttttctaatattgcataaaaattatcctttatattttctaaatctttaatagtactagtatatctaaattcaatcttttcttttcctgaagttatgtcagaatgtattttttcagaatacttatttagctttttaatgtattctaatctctctattattatattatatccaaattcaaccaattgcatatcatatacatctaaaatatctttatttatatttcgatttcttaatatactatttctttcattcagaactttattgtattgaacaagattataataatatttaggatttaattgacacaactccatatctatgaattttcttcttacgccgggagaatccttaattatctttaaatcttccggagaaaacataacaacattaaaatttccgaataattcaccgatctttttaattttaatcttgttaatttgtattgctttttttccgtccttaagaatgcttatatctattctcttatctaatctctctctacctacagaaacacttaaaagtgcattgtcggcattccaattaataagttctctgtcttttgatgtcctatgagaccttgcaaaagcacaatagtatataccctctaatatattagtttttccttgggcattatcgcccataaaaacattaacatgtggacctaagcttatatccaatacattataatttctgtaattaagcatttgcaatcttttaataaacatcttaaacacctttaattataacatattaaacttaataaggttaagcactctgggaaaaatagtctttaaactacttcgtaactttccccattaaattcaactatgtcacctttatataatttttttcctctttgagtgcaaatctcattattaactttaacaagttcatctaaaattaacattttagcctctgaacccatagatactgcacctgaaaactttaaaaatgaatctaatttaataaactctgttttaatttgtattttattcataccgcttcttgtataattattcaaactttatacaagttcctcctatcttactagtcttactggtaaaactaagtatttggcattattgctattttttccttttattacacatgggctaacgcttgaagtcatttcaataaccacgtcttcttcttccatatttttcaatacatctaataagtatcttgaattaaatgcaatttgtatgccttcaccttgcagatttatatttacttcttcccttacttttcccaattgagaattcgaagtgataactaatgtatcttcttgaacatctaatctaataagattgctatttccgtctttagccattagcgatgctctttcaatcccttgttgaagctcttgttttttaatattcactaataatttatattcttgaggtaaaagagaaatataatttacaaatttaccatctaataatctagatataatttttgtgttattaatattaaataatatgtgattattagtaaaagttatttttactatatctccattgtcttctaatatttttgaaacttcatttaatgtttttcctggtataacaacttcaatgttatcatcaacatctagtaattcacttctaacagctaatctatacccatctaatgcaactaaattaagttctttatttttaacttcaaaaagtattccttgcaatattggtctagcttcatctagcgctattgcaaaagatgttccttttatcatattttttaataaattttgtggtacctctacattaaggtcttcattgatacttggtaaagctggataatcagttgcattcatataaacaacattaaaaactgacttttcacaagtaatttgaaccaaatcattttcagctatttctatttttacgtctgaatttggtaactttcttattatttcagagaaaatcttagaatcaattacaatgctaccttcatttaatacttcagcttctactttcgtttcaatactaacatccatatcagatcctattaatgttagaccttctttagtagcttgaatgtaaataccttctagtacaggcatagtagtttttcctgttatagcttttgtaacgatagaaattccatcttgtaatttttgctttgagcatattatgttcataatcttacctcctaagttatacacagttatgcacatagaattatgcaatttaaatagataatatatatataataaatataataatagtagtagtaagggctgtggatatgtggataagtaccttaagcccttatttttcaataaaattcatgcaaaaaatactgtggataagtcggtaacaaaatcatagtcttatccacagtattcacagccaaagacgaataaatgacttatccacaaactattcactagttattatgtacagttgttgattatttttgagttagcttttttgttatatcatttattgtgtgttctaagctttcgtctttatttaggccttctgatattttttcataagcatgaattacagtagtatggtcacgtccaccaaattcctcaccaattttaggcaatgacatgtctgtaagttttctgcttaaatacatagctatctgtcttggatatgctacatttcttgttcttctctgtgatttcaagtcctcaactcttaaattaaagtaagcagctacaacatcttgaataagatctatagtaatgcttctattttgcttatttgaaattatatcttttaaagcttcagtagctagatcaacagtaatttcacgatttgttaaagatgaatatgcgacaattctaattaatgcaccttctagttctctaatattagactttatcttagtagctatgtataccataacttcattaggaacatttagtttttctacatcagcttttttctttaaaatagccattcttgtttcaaaatcaggtgcttgaatatcggcaataagaccccattcaaatcttgaacgtaatctatcctctaaagtaggaatctctttagggggtctatctgatgataggattatttgtttatttgcttcatgtaatgtattaaaagtatggaaaaattcttcttgagttcgttccttaccagcaataaattgaatatcatctatcaataaaacatcaacacttctgtatttagttctaaattcttcatttttatcatcttttattgcatttattagttcgttagtaaatttctctgatgaaacataaacaactttagcatttggattattctgaagaatataatgaccaatcgcatgcattaagtgtgttttccctagtcccacgcctccataaatgaaaagaggattataagctttagctggagattcagcaacagcaagagatgcagcatgagcaaatctattactattgcctattacaaatgaatcaaaagtatattttggatttagtgtactagacatttcgtcatttacagtaacagcaattccatcatttttaccagtgtttttatttgcttcatttttttcttccgcttcttgtatttcagatgctattacaaaatttaaattataagtttttgaacaagcagcttcgatcgaatttataactaaatctttataccttttttctaatatatcttgagtgaaggaattcggaacactgattatgatagtatttgatgatatggatattggctcgcaacttttaatccaagtgttaaaactaacctcggttaactcgccttttattatatttagggttttttcccacaattctttaagctcagtttccatttaagctatcctccaaaaaaagaaatttttaaaatttattaacaagatatcaacaaagttattaacaaaaaaatgattatgttgataaagttgataagtttaataacatgttaacaatttatgtagataatataattacattatagttatccacaattttagatattataaacatagatattattaacagcgaataaaagccctatttttgataataataactaagtaattatagagttaataagaaagattgaacaagttatacacagattaatccacaattgtggataagttaagttattcacatttttattcacacttatacttaataatatcatatagttatataagttatcaataagttatccacaaattttagcctgtgaataaaattatcaacagttttacggaatttaattcatattgacagtaaaaaggtaaatatatataatgataaggtaactttaaattgagaaatatagtttttactataaataaatcactcaaagggggtgtatttcgaatgttcatgacataccaaccaaaaaagagacaaagaaaaaaagaacatggtttcagaaagagaatgagcactgcttcaggaagaaacgttcttaagagaagaagacaaaaaggtagaaaaaaattaacagcataagggccgcactttgtggccttttttctgcacatgcaggtattttaaggagagtttattaaaacttatgatatacaaattaagaaagaatacagaatttagacttgtttacagaagaggaaagtcttatgctagtaaattattagttctatatgtttttaataataaaaagaatattaatgaagaaaatgaattatataataaggtaggaatttctgtaagtaaaaaagttggaaatagtgtagtaagaagtagaagcaaaagattaatatatgaaagctatagattaaatgttaaagatattaaaactggatatgattttgtttttgtagctagaagcgctattaatgaaaaaaaatatagcgatgtagaggcagctatgataaacttattgaaaaaggcaggaatatatttgaaatgaaaaaattgcttttaaatattataaagctatatcaaaaatattattctcctatgagacctagaagatgtatatttgttcctacatgctcacagtatgcagttgaagcaattactaaatatggtgtacttaaaggaggatttttatctataatgagaattgcaaggtgtaatccttttaacaaaaatgggggatatgatccggtaaaataaggaggctattagaatgtggaatgcaattgtaaatgtaatgacgaaaatgttcaatgctttacataatatgattattgcattaggggtaccagaacatgcagaagggatttcgtatgtattagcaatcgtgctttttacagcaattataagattattaatattacctcttaatattaaagcaacaaaatcaaatgcaaaaatgcaagaaatacaaccagaaatacaaaaacttcaaaagaagtatgcaaatgacccgcagaagttacaattagaaacttctaaattaatgaaagaaaacaatgttagtatgtttggtggatgtttaccaacattattaccattacctatattatttgctttatatggtgtatttagaactataacagcaacaccaggggctgatacatcgttcttattcataccagatatatttagtattggtggaattaactttgtttctataatattagctatattagcagcattaagcacttatataccatcattattattaagcaaatcaatgcctcaacaagaaggcggaatgaatatgagtactatgaatattgttatgtcaggtatgatgggattcatggcacttcaattccaaccaatattagtaatttattggataactggtgggataattcaattaattcaaacatatttcttaaattatcgtccagcaatgaaaaagaaaaaaattgaagaagaaaaattagcacaagctaaaattcaaaaagctaaaaaatctacaccaaaaactaaaaagagataattatcatattttataggtggtgaatagggtatgaaaacaatagaaatgactggtaaaacagttgatgaagctttacaaaatgcattagatgaattaaagcttacaaaagaaaatgtagatgttgagatagttgatgagggaagcaagggtctatttaacttaataggagttaagccagcaaaggttagggtaactaaaaggcctgatagtatagataatgcaaggaagtttttaactgatgtattaaaatctatgaatataaaggctgatattaatattaaagaagaaaatgatgttgtaaatattaatttatatggcgataagatggggttagtaataggctatagaggtgaaacattagattcgcttcaatatttagtttctttagtgataaataaggatcacgataatccatataagcgagttgtattggatgcagaaaactatagaagtaaaagggaagaaactctagtaagagttgctcaaaaaactgcttataaagtaagaaagtctaaaagaccttacaaattagaacctatgaacccatatgaaagaagagttattcattcagcgttacaagaattcaatgatattaacacatatagtgaaggtgaagagccttttagaagaatagtaataagtttcaaaaaataataagagaagacttaaaaaagtcttctcttattatttttttagaattttgacttatataaaatagttatgtaaaatgaataatagcgaaaatagggcataataattaaaaacagaaaatccggaggattaagaatgaaagaatttgatacaatatgtgctatagctactgctttaggtgaaggtggtattgcgattattagaatatcaggggataaagcattagatatagcatcaaagatttttaagcctaaaagcaatgatgatattagaaatatgaagtcttatacaatgaagtatggacatatttatgatggagaaactgatgagcttattgatgaagtaataattagttttatgaaagggcctaaaagctttacggcagaagatacaatagaaataaattgtcatggtggagttgtttcaactaataaagttttagaaacagtaataaaggccggagcaagacttgcagaaccaggagaatttacaaaaagagcatttttaaatggcagaattgatttatctcaagctgaagctgttatggatataataactgctaaaactgatttagcaatgaaatcagcattgatgcagagtaatggatatttatcgaaagaaattaatagattaagagaatatatgctaaatatattagctttagttgagtttgcagtagactttacagaagatgatgaagaaatagatccaagtataccattaaaggttggagaaagtttagaaaaggctataagtgaaatgaatggacttttaaagagtgcagatgaaggaaagctaataagagaagggctaagcttagcaattgtaggtaagcccaatgtaggtaaatcatcactattaaatgctttattaagacaaaaaagagcaatagtaactgatatcgctggaacaacaagagatattatagaagagtacataaatttagatggaattcctgtcaaaataatagatacagcagggattagagaaactgaggatgttgtagaaaaaattggagttgaaagatcaagagaaaaaatccaagaagctgacttagtattattagtacttgattcatcaagagaattagatgatgaggataaggaaattattgattcagttggagataagaagtgtattgttatattaaataagatagacttagaatctaaaatagatgaaaagataataagtaactttgataacataatcaaaatatcggctaaagaagaaattggattaagtgatttaaaagaaaccataaaagaattattctttagtggaaaaattgatacagaaagtctaattatatctaattcaagacataagcaagcgctatttagagcgttagaaaatgctgaaatggcattaagtaaagtaagaatgaacgaatatttagatttaatatctatttttgttacttcagcattaagagccttaaatgaaattactggtgatgaattagaagaagacttagtaaataaaatatttggagatttctgtgtaggaaagtaggagtatagaaatgagatataatgcaggagaatacgacgtagttgtagttggtgctggtcatgcaggatgtgaggcaggacttgcgtcagctagaatgggattaaagacattagtatgcacaataaatcttgatgcaatcggattaatgccatgtaatcctaacataggaggtacagctaaaggacatttagtaagagaaattgatgcacttggtggagaaatgggagttaatatagatgaaacattcattcaatcaagaatgctaaatacttctaaagggccagcagtacactcattaagagcacaagcagatagaaaaaaatatcaaaatagaatgaaaagtgtattagaaaatcaagaaaatcttgaggttagacaacttgaagttattgatgttgatatagaagatggtaaagttgttggtgttttaactaaaaatggagcattttttaaatgtaaagcaataattttaactacaggtacatatttaagagcaaaagtaataattggagatgttatttataacagtggaccaaatggtttagcaccagctaatgaattaactcaacatttaatggaccttggaatcgaaatgagaagatttaagactggtacaccagcaagaattaacaggaagtctgtagatttttctaagatgatagaacaaccaggtgatgaaaagatagtaccattttcatttatgaatgatagtattgaaagagaacaaatttcttgttggttaacttataccaatgatgaaactcataatattataagagaaaatataggtagatcgcctttatacaatggaagtattgaaggagtaggaccaagatattgtccatctatcgaagataaggttatgaagttccctgataaaaatagacatcaaatattcatagagcctgaaggtgaggatacattagagatgtatgtaggcggaatgtcttcatcattaccagaagatgttcaaattaagatgtatagaacattagatggtcttgaaaatgttgaatttttaagaactgcatatgcaattgaatatgattcaattaatcctatgcaattaaagccaacattagagtttaaaacggtagaaggcttatatggagcagggcaattaaatggtagctcaggatatgaagaagctgctgcacagggaatagttgcagggattaatgctgctttaaaaatcaagggtgaagagccaatgatattaactcgttctgatgcatatgcaggtgtcttaatagatgatttagttacaaaaggtacaaatgaaccttatagaatgatgacttctagggcagaatatagactattattaagacaagataatgcggaccttagattaactgaaataggaagaagagtaggattagtaacagacgaaagatataatagattcttgaatagaaaatctaatatagaaaatgaagttgaaagattaaagaacttacaaataactaataagagagaaaataatgaattcttagttagtcttaattctacagaattaaagaagcctattagtatgtatgaattaatcaagagacctgaattagattatttcatgttagcaccattagatttagaaagacctaattatacagatgatattggggaacaagtaaatataatagcaaaatatgaaggatatatatctagccaattagatcaagttaagcaatttaagaaatttgaaaagaagctattaccagaaaatatagattataatgatataaagggattaagggttgaagctattcaaaagttaagttcaataagacctgtaagtatagggcaggcttcaagaatatcaggagtttctccagcagatatatctgtattacttatttatttagaacatcaatataagaagaataaagtggaggaataaaatgaaattttttgacttaatgaaggaagctgcaaatgaagcaggattagaattaacagaagtgcaatatgagcaattcattaaatatatgagacttcttcaagaatggaacgaaaaaattaatttaacagctataactgaagatgaggaagttataaaaaagcattttatagattgtattaaagcttttaaatctgatgcaattaaaaatgctaagaatataattgatgttgggacaggagcaggttttcctggattaccaatagcgataatgaatcctaacgtagaagtaactcttttagattcattaaataagagaattaattatttaaatatagtagtaagagaacttggattaaagaatgttacaactattcattcaagagcagaagatggagctagaaagccagaattaagagaaaaatttgatgttgcaacttcaagagctgtggctaatatggctgttttatctgagttctgtatgccatatgtaaaaaaaggtggatattttgtagccttaaaaggaccttctatagatgaagagcttaagaatggtggtaatgcaataaaaactctaggtggtgagttaaagggaataatagaaatttctattgaagaaactgatttgaagcataatattgtagaggttgtaaaaataaaatcttgccctaaaacttatccaagaaaagctggaacgattactaaaaaaccattataaaaaagcaaattaataaagtgggatataatgcaaaatataatatatagcatagtaatttatcttacgaaaactatagaaatatagaaggaaataaaaaaagaaaagtagtattgttaaaatatggaacaaaatgttggttaacaaattgtgagggatggtcgtataaatatgaataaagaaataattaacataagggtagaaagtatttttccaaacacatatcaaccaagaaagttttttaatgaagaggcactaaatgaattgagccaatcaattaaagagtatggcataattcaacctattactgttagaagaataggagataaatttgaattagtagcaggagaaagaagatggagagccgctcgaatggcagaacttgaatttgtaccatgtaatgtaatcgagattacagatacagaatcagcggagctagcattattagagaatctgcaaagagaagatttaaatttcatggaagaggctgaagcatattataatttaattaatgaccataaatttacccaagaagaattagcaaaaagaatgggaaaaaaacaatcaacaatagctaataaattgagattattaaagctaagcgataaagtgagaactttatgtcttgagaataatttaacggaaagacatgcaagagcattattaagtttaccaaatgaagaattacaattaaaggttgtgaaaaaggtaatagcaaattctttaaatgtaaagaaaacagaagagttaattaataccgaattattaaaattagctggtgaacaaatgaaaaagagaaaaggtaaaggagttttaccaggaaagttatatgttaatactataaagcaagtattaaataaatttaatattccagctgaatacaaacttcaagataaagaagaatgtattgagataacagtttctattcctaaaaacaagtaatattttcaaggcactcaaactttattttgagtgtctttttttataatatgtttcacgtgaaacattaatatatttttttgtttaaatgtttcatgtgaaacattaacttaaatttcatcttatttttaataacaccatctttaactattacaagaaaatatatataatatacatatgggaagggggtgaagtccttaataaggactttttatgaaaaagatttgtatttttaatcaaaaaggtggagttggaaaaactactactaacataaatttatgtgcttttctggcaatggaaggatatagagtattaacaatagatattgatcctcagggaaacacaactagtggtttaggattagacaagagaagcttagaatattctatgtatgatgtactaactgctggtgcttctttagaaagtgttattattaagagtgaattaattcctaacttatacatagcaccatcaactatggaattagcaggtgcagaagttgaaattataggagtaaaagatagggaaactattcttttaagagaaatatctaagatacaagatcaatatgattttatatttatagattgcccaccatcattaggtgttttaacaataaatgcattaactgctgttgattcagttttaattccaatacaatgtgaattctatgcattagaaggtgtagggcaattaattaatactgttcaattagttaaaaaatcattaaataagtctcttgatatagaaggcgtaataatgaccatgtatgactatagaactaatttaagtaatgaagtatatgaggaagcaaaaaaattcttcaatgataaggtatataaaacgactattgctagaaatataaggttagcagaagcaccaagctttggattacctattatgctttatgatgaaaaatgtaagggtgctacagcatataaaaaatttgcgaaagaatttttaagtaagcaataaaggggttgagaaatatgagtaaaaagtttggattaggtaaaggtctgaatgctcttatacctgaagatactatgattttagaaaaaaaagaaactaaagttgaaagtaaaaatgaaggatatacattaattgatattaatctaattaaaaataatgatagtcaaccaagaaaaagatttgatgacgaaagaattatggagttagcagaatcaataaaaagcaatggcatagtacaacctttaatattaaaaaaggataatagtgaatatgtaattgttgctggagaaagaagatggagagctgcaaaatcaataggaataaaagaagttccagctgtagtaatggatttgactgaaaaacaagtattagaaatatctttaattgaaaatattcaaagagaagatttaaattctatagaagaagctactgcatataaaaggttaataagtgattttagtttaactcaggagcaattaagcaagagaataggtaagtcacgtgttgctataactaatactttaaggttattaaatttaagtgatgatgttcaacaatatattattgagggagtcatatctgaaggtcatggaagagctttattggctattaccgacagtaaacttcaatgtgaattagctcaaaatgttattgatgataaactatcagtaagagaattagaaattatgattagaaaattaaaagatgattctggtcgatctaaaaataaatctcgaaaagaaaataatccttattataaagatgtaactgaaaggttagaaaattattttggtactaaggttaacataactaataaaaataataaggggaaaattgagattgaatactattctgaagaagatttgcaaagaatactagagataattaatttataaatgtttcacgtgaaacatttgaagggaagaagcagaagatggacagcataataaatataattaatcaatattcaatctttataataataggattagcgataattacattattattatttataatgactatgatattattatcatctgtaaataaacttgaaaaaaagtatagaaagatgatgagaggcgttaataataaaaatttagaggatgcattaaatgataatttagataatattgaaaaagcccttgaacagtcagaaatagctattaatgaatgtaagacactttctgaaaaaatgaagggatgtgtaaataaaattgctattatgagatataaagcctttgaggatgttggaagtgatttaagtttctcagtagcgatattagattcattcaatgatggggttattataacaggaatctattcaagacatgatagtacaacttatgcaaaacctatagataagggaatatcaagatatgatttatcagaggaagaaattcatgtactaaatgaagctattaatagtaaaaattaaaataacatggttataataaatttatttattataaccatgttatttttatatttatattaatggaattaatcataagataacatggtattattcgaaagggctttattaatgaaatgcttaattccattagatatacaatctgctaaagacataacaacaaataatctagtattttgaagcatcataaagtctaaattaccagatatatttacaacgccttttatgctcatttcccctacactaggtaagtctttatttaaggctaaaccagggtgtaatggcaaatcttcaataaatatcttaccaatttgttgtacattgcctaacgaggcatctattccaataataaaaggatttttaaaattagaatcaattttatttaaaatatctattagattaacagaatgtacaggatattctaatgaaccatatacataaatatttttatatgataaatttttaagtttataaccaattaaaggccccaatgaatctcctgttgcacgatcagtacctatacataaaaaaattataggtcgattttcagcaataatattttttaattttatatataaatattcacctaattcatgatgggaattaggtgataatgagtctaattcgaaacaattatccatatcataaaccctcctattgaaagtatcgacaagaataatgtaacctattcatttaatataaaattatttataaatattattaattttatttaagcaatctaaggtgtattttatttcctcaacggtattaaaatatccaatacttaatctaacagtaccattagggaaagtgccgatagttttatgtgctagaggagcacaatgcaatccgcttctattactaatgttaaagtctgaatctaatatatatgataattcgcttacatctaattttgaatgagttatagaaacacaagatgtagcaaggtctctatctaaagcaccactaatattataattaggaatatttaacaatccggaaattaaaaacgatcttaagtaactattatgttcataaatagtatttaggccttcattatttataaattcaatagcttcagataatccaattattccaggaatatttaatgtaccagattcaaacttatcaggtaagaaatcaggttgagttaaagaatgagatagactacctgtaccccctaaaatgctaggagtacaaattttatttaatttgtcatcgatgataaatccaccaattccttggggaccaagaagacttttatgtccagtaaaagctaatgcatttaatgaaaattcattaaaatcaatattaagaacaccagcactttgcgcactatctaatatgaaatagatattattttctttacatatttcgcctatttgctttatgggttgaatagaacctgttacatttgaagcatgagtaattactattaattttgtattaggtctaataagtttttttatagtttcaacattggttattccttgagagtttgcttgagctatatctaattcaatattaaaattttgagatagattatataaaggtctgattacggagttatgctccattgatgaagtaataacatgatctcctggtttaatgattccattaagtagaatatttaatgatgatgtaatattattagtaaaaataacattttcagctttgttaaaattaaaaaaattacagattttttctcttgtatcatataacactctatttgctgccaatgattttggatgattagatcgcccaggattaccaccaacgttagttaagtaattatatattgaatcagcaacaacttttggtttaggaaaagatgtgctaccattatctaaataaactttcatatgctactcctttaaacttttattattgtaaattataagaaaatttataataaatgtatctacatattataatagaataaataaataaaaatgcaataatatttagtaaattatgtaataaataaataaggtattaaatatttataaaaataaaaaaaacgttataatataattaaatgacgtttaataaaaggagggaaaagaaatgaattattatattatagtatttaaaaatactcataatgcaatgactgctgaaaaaaaactaagtgaattaaattataaatttagaattatgccaacacctacagtaataactcaaagctgtggaatttgtgtaagaattgaaaatgaagaagtagtaaacaatataattgaaaataatatagttgagtttaaaaatgtatataaaagagatgaggctcaatatactttagtaaaatagagtaaaggggtgacataatgtatgcagttatagattgggataattacagaaataaaacggttgacttttttattaaaagaataaatttagatttaataatagaaaaaattataacaattatttttatagctattataatgtatttttctattagaataggaaataaattaattaataaatttgttgatagacaagtaagaagtaaaactagtttttcattagagccacagaaagcgataactataggagaagttcttaaaagtgtactaaaatatacggtatatattattggtataggatcaatgctatatgatattttaacaagaataccagtagcattagcaagtgcaggtggatttgcaattggtattggagctcaaagtttagttaaggatttaattaatggattttttattttatttgaggatcaatatggaataggagattatgtaacaattggacaatttgaaggaatagttgaaagtattgggataagaacaacagttcttagagattttactggagatttacatttaatcccaaatgggacagttttagaggttacgaatcattctaggggtgatattagattcatagtagatgttgaaatcgcttatgaagaaaatatagatgaaactatagagttaattaaaaaagttaatataagctttcaagaaaggcatgcagatgagcttagaggtgatatacaagtattaggagtactttctttaaatgcatcaggagttacgattagagtaattggaaggtcagttcctttaagtcaatgggaaatggagagagagctaagaaaagaaataaaaatggcattagataaagctggtatagaaatcccatatcctaaaactgttatagtaaacgagaaataattaataattaatagtcagtagttaagtaataaattctcagggcaggattttaaaaatatattattaagaaactcatgagagttttcattaataacttttaactcaaaactattaactaaataaagctgggggtaaaataaatgattgaaacatttgatttaggcgatattgttgaaatgaaaaagcagcatccttgcggaagtaaagaatttgaggtaataagattaggcgcagatattaaaattaaatgtgtaggctgtggaagaatagtaatgattccacgcttaaagttccaaaaagatgcaaaaaaggttgttaaaactaataattgaaataaaaatacttgaaaagtgtaacataaagtgataaaatttttaattgtaatccctgctacagtaaaatgtagccgttaagtccaaaggaggtgaaaatgatgagaaagtacgaaactatatttatattacacccatcatttgatgaagaagctgttaaggctaacatcgaaaaattccaaggtgttatagaaaacggtggaggaaaagttgaaaatgttgatttctggggtaagagaaaacttgcttacgaaataaacaaagttagcgaaggttattatactttaattaacttcgaagctggttctgaattaccaaaagaattagacagagttttcagaattactgatggtgttataagacacataatcgttaaaaacgaagcgtaagaggtgtatttgaatgaataaagttatacttattggtagacttacaaaagacccagaattaagatatgcagctggtagcggtactgcagtttgcagatttactgtagctatcaatagacaatttaaaaaagatgaaacagattttataaattgtgtagcatttggaaaaactggcgagacaattacacaatatcttacaaagggtaggcaaatagctgttactggaagtataagaacaggtagttatgatgctcaagatggaactaagagatacacaactgatgtagctgtagaaagtttcgagttcataggttcaggttcaggtgaaggtaataacaattcttactcaagaaattctgatactacttggaatactccaagtgaaagcccagatatgggatttggagacatgactccagttgatgatggagatatgccattctaaaaaagtctaattattttaataaggaggaaacaaccatgagagatatgaaaagatctggtggaaagatgagaagatctaagagaaaagtatgtgctttctgtgtagataaggcagaatcaatagattacaaagatatcaacaaactaagaaagtttgttacagaaagaggcaagattcttccaagaagaatttctggaacttgcgctaaacaccaaagacaattaactgttgcaataaagaaatcaagaaacatagctttattaccattcacaactgaatagtaattagtttattagcccctgggttgtcaggggcttttatttttatataagaaaaaaattacataatttgtaataaacacccctatttagttgcaataatatagaaaaataattaaaatataaatacaaggtattgaatagaggtgagaatttagtgaagaaaaaagaagaattgaatattatggcaaatataaaaataatagaagagcttaaagctaatttattatgtattataggagaattcttttcattattaacgagaggaacgaatgttgcaaaggattctatattaaattgtatagcaggagctattttaattttatatgttttagctcaaaaattggggtatagttgtaatgaagtagatgatgaattaagaaaaaaattaaaattaggtatagcggaagaacatgaatatgaaaaagaaggtaaaagtttaacaaaacttcaaaatcatatcaagggacgttattaatataaaatttaggaggcttttatgaaacaaaagctcaaaatgtataggtctttattaatagcaattatagttagtatttttgcaataatactttattattttggatatttttatatagctagtattatattaattatatatgtagcatttaaagaatatttaaatattgataaagaactaaacaataataagtttaataatctaactgataagattaagcataatataaatgataatatttctaatatgtcatatcctatagctttaattgataatgagggaaatatactttgggctaataaaagattaaaagaagaattaaatttgttagatttacaggagcaaaatatacttagtataggtagaaatcttgatttacataagttattaaagtgtgacaaagatttaagccaaagagtaaagataaaggattctttttatagtatatacgctaacaatataagtgatgaaaatattaaatataatgaatcgaaatatttagtatattttaatgaggtaagtaatttaagagatttatattcaacaagagaaagcataatgttaattgaggtagataatttatcagaagcattagagcgaactgatgaagcaaataggcctatgttagcggctgaagttgagaaggaaataaattcttatagtaaaaaattaaaagctatgattgttaagtatgaatataataagtattgtttatcagtgcaagataaatatataaatgatgaaattaattgtaagtttaatattttagataagatttcgagtatagatagaggtaataagttagaagttactttaagtattggaattggtagaggtggagataatcctcaggaaaattataacaacgcaatgacagcacgagaattggcattaggtaggggtggagatcaagtagttattaaaaataatgaaaaaataagcttctttgggggaaatactcgtgaattagaaaaaagaactagagtaagagcaagagtaattgcgcaagctgtaagagagctaatatttgaaagcagtaatatattcattattggtcataaaaaccccgatatggattcgttaggcgcatctgttgggctatggtcagctataagacagctaggtaagaattgcaatattataattgataatgatactactgcaattgattattatatgacaaagcttaaaaaggatgataaatatgataatttatttatatctagtgacgaagcagaaaaaaatattaatgaaaaaacgttattaattatagtagatgtgcataataaaggatacgtgaataatataggtattactgaaaagattagtagaaagataattatagatcatcatagaagaagtcctgacataatagagggagcattattaaattatatagaagtatatgcatcgtctacttcagaaatggtaacagaattaattcaatatatgctacaaaagccaagaatacctaagatagtagcagaaggacttttaggtggaatttttatggatacaaaaggattccaatttaaatcaggggttagaaccttcgatgcagctgcatttttaagatcattaggtgcagatactattgaggttaaaaaaatgtttaccgatagtttagaggactacttacttatatcggacactataaaaagcgcagaagttcatgaaaatttagctattgcagtttgccctgaaagcgtaaataatactgttatagtagcaagagctgcagatgaattattgggaatatcaggaatagatgtatgttttgttttatgtaaaataaatgattcaattaatattagtggaagatctactggggaagttaatgttcaagttatattagaagaacttggcggaggaggccatatgaatatggctggcgctaaagtagaaggtacaatagaagaagcagttaatgtgttgaaagaggcaattaataagcatttagagcttaaggaataaaacattaaaggataggtgtataaaatgaaagtaattttactacaagatgttaaaaaaatgggtaaaaaaggtgatgttatagaagcatcagatggatatgcaagaaattatttatttccaaggaaattagcagaagaagcaactgcaaatgcattacatgttgtaaatgctaagaaagaaaatgaaagaaagaaaaaacttgctgaattagaagcagctcaaaaattagcggccgaattaaaaggtaaggaagttactataaatgctaaagctggagataacggcagattatttggagcaataactaacaaggatgtggctgaagtaataaatagccaattcaatttatcaatagataaaaagaagattgttgtaaatactataaaggttgcaggaacatacgaagttgaagttaaactatacccagaagtatctacaaaaatgaaagttaatattgttccgaaacaataaggaggattaacattggatttatataacaaagaagcaaggttagaagatcttttagaagaaaacttgccaatagaagtaaaggttaatgtactatttgatgtacttaaaaatgttttagatgaaggtgcaattagagctagaactataagatttaagttacagaagtatgttaattcaacaaatataaatgaaagagtatatgcattagatgttatagcatctgatggaaatggagctaaggttgtaccttctgatgaagaattagaaaagtctttagaagatattgtttattggatatcagaaaatatagccaagaaatatgtgcaaaataaaatagaagctgatgttgaaaaagctttagtcgaaagacaagataagtttatggatgaacttagagtttctataataaagaagcaaaagggaaaagagaatactaaaactacagctaagttagagagattagaaaagttagatgcaaagcatattaataaaaatgttatgtcacttttaagacctgaaaactttgaagaagtagtagggcaagagagagctgtaagatcattaatttcaaaaatgtcttcaccatatcctcagcacataattctttatgggccaccaggggttggtaaaacttctgctgcaaggcttgcattagaagctgctaagaatttaaagtttactccatttgatgaagattcaaaatttgttgaagttgatggaactacattaagatgggatccaagagaaataacaaatcctttattaggatctgtacatgatcctatttatcaaggaagtaaaagagatttagctgaagtaggtgttccagagccaaagactggattagttactgaggcacatggaggggtattattcattgatgaaattggtgaattagatgaaatacttcaaaataaattattaaaggttttagaagataagagagttgagttttcatcttcttactatgatccagatgatgaaaatattcctgaatatataagatatttatttgataagggagcacctgctgattttgtattaattggtgcaactacaaaagatccaagtcaaataaatcctgctttaagatcaagatgtacagaggtttattttgaacctttatcatctaaagatattgaaggaatagtgaataatgcatctgaaaagctaaatgtaaagcttgaagatggcgttgctagactaattagtcaatatactattgaaggtagaaaagctgtaaatatattagctgatgcatatggatattctttatttaatcaaaatggagaagagtcaaaaaatgaaataacattaaaagatgttgaagaagttatttcaattggaagatattcgccatttgaaagaatagataatttagataaaggtgaaatagggcatgtatatggattaggcgtaagtgggttcttaggttctacaatagaaatagaatcaactgtgttcccagctaagaaaaaggggcatggaactatcaaatttaatgatacggcaggttctatggctaaggattctgtatttaatgctgcatcagtaataagaaagataactaatatggatattaatgattatgatattcatgtaaatgtaattggtggaggaaagattgacggaccttcagctggagcggctattacagtttgtataataagtgctcttacagagagacctattcgtcaagacattgctatcactggagaaatttctttaagaggaaatgtaaaaccagttggcggtatatttgaaaagatatatggtgctagaagaaagggaattaaacttgttgctatccctaaggataatgaaaaggaagttcctctaggacttgaggatatagaagttaaatctataaatcatatagaggaacttatggagatagtatttgagaagtaatgtagattaagcttcctatagtgggaagcttaattttattatgtgaagaaatatatttattattcaaattgctactaaaattaactttttgtataataagtttataataaataaaaagtaattaaatttatctaattacaaatttggaggtaggttgcttatggaatcacctatgatgagaagtttaccgcaaagtattgaggcagaacaatctgttataggagcaatgataatagataaaagtgccattgctcaagttttagaaaagcttaatgaagatgatttctatagggatggtcataaggctatatataaagctattaaagaaatgtatgctaaagatatggctgtagacttagttactatattggagtatttaaaaactactgatatgcttgataaagcagggggagttacatatatatctgagttaagtgcatctgtaccaacaacagctaacttaagctcatatataaagatagtagaagaaaaatctacattaagaaggttaataaaagcttcaacatctattattgaagaaagttacaataatggaggagatgtagaaaaggtaattgatttagctcaaaaaaaggtttttgatatagctgaaaagaaggactctaaagaatatgaatcactttcaaatgttcttgaaagaggatttttagaaatagaaagattatttaataatagaggagcaataacaggtgttggatctggaataaaggatttggatgcaaaaacatctggattccaaaagggggatatggttctaattgcagctagaccatctatgggaaaaaccacattctctttaaatattgcggaaaatgcagcattaaaagaaggtaaaagtgtagtaatattctcactggaaatgtctaaggagcaattagcatataagttattatgttctcaggcaaatgttgatatgttaaagcttagaacaggtaatttagaagatgacgattgggagagaatagcaagggcaacagggcctttagccagtgcaagaatttatattgatgatactgctggtataagtgttatggatatgaggtctaaatgcagaaagataaagatggaacatggaattgatatgattcttattgactatttacagcttatgtctggtagtgctggtagtgataatagacaacaagaagtatctgaaatttcaagatctattaaagcattagcaaaggaaatggaatgtccagtaatagcattatctcagttatctcgtgctccagagcaaagagccgatcatagaccaatgctatctgacttaagagaatctggatcaattgagcaggacgccgatgttgttatgttcttatatagagatgaatactataataaagaaactgaagaaaagggtattggtgaatgtattatagctaagcaaagaaacggcccagttggaactgttaagatggcatggattggtgctcactctaagttcgctgatttagagttagtacacaaagaatagcgttagtagttttaatatagttagtagtttagtaataaattcagattagaactaaagctactaactcaaaactattaactaaaataagggtggggtgttgtatgaatagaaaaattggatttataggttgtggaaacatgggtaaggctatgttagggtctttagttaaggctgataatattattaatgataatattatagtttctacaaaaagtaaggcatctgcagaaaaaattaatcaggaatatggtgtaaaatcaactactgataataaggaagttgctagtgaagttgatgtgctatttttggctgttaagccgtatttctttaaagaagttattgaagagataaaagatttaattaaggatgaggtaattattatttcaattgctgcaggggttacaataaatcaaattgaagaatggtttggcaaagaaattaaaatagttagaacaatgccaaatacaccagctttagttggtgaaggtatgtctgctatttgcccaaatttaaatataacagaaaatgaattgaattatgtaggtagtttatacaatttatttggtaaatatgaagtgcttgaagaaaaggattttcatgcctttattgcattatgtggttcttcaccagcttatgtatttatgtttattgaagcaatggctgatgcaggagttaagcttggattacctagaacaaaggcttataaattagcagaacaggcgattttaggttcagcaaaattagccttagaaacaggaaagcatccaggagtacttaaagatgaggtttgctcaccaagcggaactactattgaagctgtaatagatcttgaaaagaatggatttagaaatactgtaataagtgcagttgaaaagtgtgcagacaaatctagaaacatgtaatgaatttattatttgaaaaatttattgtggaaatgtattaattaaacatatataatattaaataatgaataaatttttattataatgaaataattaagaatataaaattctatgaaaagaagagtacttattcaggtgtattttacagcgagtagggatagagtgtaagccctataaaatatagaataaggaagaggaacttggagaagctgcttgagtataagttaatactatatgagggtaagccgttaactgcgttaaagttttgagtgaactaaattttttagttaaattgagtggtaccacggaaatattccgtctctttgtatgaaaagaggcggattttttatatttttaagacaataaggaggtaaagttatgaaaatatttattgaaaaaataaatgatgtagttaaaagtgcttttgaagaacttggatatgaaagagaaacaggtagggtaaatgtatctaatagacctgacctatgtcaatatcaatgtaatggggctttagcaaatgctaaaaagcataaaaaagcaccaatgataatagcgcaagaggttgttgaaaaattaaatgataataagatgttttcaaaattagaagctgtagcaccaggatttattaacatgaatattaatgatgaattcttaatagattatgttaatgaaatgaaaaaagatgaaaactatggtgtttcaaaaactacagaagtaaaaaagattgttgttgattacggtggagctaatgttgctaagcctttacatatagggcatttaagatcagcaataataggtgaaagtataaagagaattgctaaatttttaggtcatgatgttgttggtgatgttcatttaggagactggggtcttcaaatgggaatggtaatatcagaagttgaaagaagaaatccttctttaccatattttgatgcaaactttactggagaatatcctgtagaagcaccatttacaatcgatgaactagaagatatatatccatatgcaagtaagctagctaagagtgatgaaaaagtaatggaagctgcaaagcaagctactgttgaacttcaacaaggtagaagagggtatgtggctttatggaagcatatattaaatgtttcagttgctgatttaaagaaaaactatggagcattagatgtaagcttcgaattatggaatggtgaaagtgatgcacaaaaattaattccagcaatgatagaagaattaaagcaaaaaggatttgctaaggaaagtgaaggagctttagtatttgatgtaagtgaagaaactgataagagtccagttccaccactattattattaaaatcagatggagcatctttatatggaactactgacttagctacagttgtagaaagagttagagatatgaaggctgatgaaataatatacttagcagataagagacaaggacttcactatgaacaattctttagagctgctaaaaaatcaggaatagctaatgagaatactgttttagatttcataggatttggtactatgaatggaaaagatggtaagccatttaagactcgtgaaggtggagtaatgagacttgctgacttaataagcatgattaaagaggctggtaaagaaaaacttaaggataataaaaatatagcagaagaagacgttgaagaaatatcttcaaaagtaggattagctgcattaaaatatggagatttatcaaatcaagcatctaaggactatgtatttgatatagatagatttgcttcatttgaaggaaatactggaccatatattttatatacaatagtaagaattaaatctatattaaataaagcagaaggctttaatgcagaaaatagcattttagtacctcaaagcgaatcagaaagagctttaatgcttcaattagctaaatttaatgaagttatagagttaagctttagagatagagctcctcataagatatgtgaatttatctatgagctatctaataactttaataagttctataatgatacaagaatattatctgaagaagatgaagctaaaaaattatcttggttaagcttaataaatcttgttaaagatgttttagaacaaggcctagagctactaggaatggaaagtgtagaaagaatgtagttaggatactaacgtgaaattagctagattatcaataggtgataaagatagttttactgtataggtcaatcagaataaatagaaaaaacaaatgttgtattcaagatgagatttcattaattctcggaaatataacatttgttttttcgttattactatgatttatatagttgcagctccactttttatagcagcatctttaactgcttcagcaactcttttttgaacttctaaattaaaagctttagggataatataatttggattaagttcttcatcagaaacggaattagcaattgcatgagcagcagctattttcatttcttcattaatttcagtagctctaacatctaaagcacctctgaatattccagggaaggctaatacattattaatttggttagggaaatcagaacgtcctgtaccaattactttagcgcctgcttctttagcatcttcagggaagatttctggtgtaggattagccatagcaaataaaatagcatcagtattcattgaagaaaccatttcttttgatactatattaggagcagaaacacctatgaatacatcagcattctgaataacatcttttaatgttccagattcattatttggatttgttatattagaaagctcagtaaagtagctgtttgtataatcagtatctctgtttaaagctccatctctatcacatacgattatattttttgctccataagatagtaaaagtttagttatagcagtaccagcagaaccagctccattaacaactatttttaaatctcctatatttttattaactatttttaatgcatttattaatccagataaaacaataatagctgttccatgttgatcatcgtggaaaacaggtatatttaatctttcttttagcttcttttcaatttcaaaacatctaggtgcagatatatcttctaaatttattccacctaaagtaggagcaattctaactactgtttcaacaatttcatcaacttcttttgtatctaaaactataggaaaagcatcaacgtcggcaaattccttgaataatatagatttaccttccataacaggtaacgaagctaatggtccaatatcaccaagccctagaactgcagtaccatcggaaataacagcaactgtgttccactttctagtgtatagatgggctgttgatggatccttatgtatttctttacaaggttcagcaacacctggagtataagcaagagataaatctttttcatttcttactttcactcttgaagatatttccaacttaccttttaattctttgtgaaactttaatgattcttcataaatattcataataagactccttttaaaatatacttataacattattatacgaattatagaattataaagcaaaaaaatattcgtagaaatgttgaaattttgcaattactttgataccatgatatataggattataatgcaatataatctatttagtaagtcttaaaaggaggcaatgtataaatgtcagcatttattgttttaggagctcaatggggagatgaaggtaaagggaaaatgacagactacctagctgaagaggcaaatgtagttgttagatatcaaggtggtaacaatgcaggtcatacagtagaggttggagataagcaatataaacttcacttaataccatcaggtatattacacgatgaaaagcttaatgtaataggaaatggtgtagttgtagatcctatagctttcttttcagaaattgattatttgaaagaagagggagttaaagtaactccagaaaagttaatagtaagtgatagagcacacataattatgccgtatcataaggtattagacaaattaaaagaaaaagcaagaggaaaaaatgatatcggaactactggtaaaggaattggaccttgctatacagataagtttgaaagatgtggtataagagtttgtgatcttatagataaagaagtatttaaagaaaagcttaaagaaaacatcgaaatgaagaataaatatatagttaatgttcttggtggagaagcgctaaactttgaagaaatatatgaagagtattctaaatatggtgaaaaattaaagccatttgtaaaagatacatcagtaagagtttataacgaaattaaagatgataaaacagttttatttgaaggcgcacaaggaatgttattagacattgactatggtacatatccatatgtaacatcatcaaacactactgcagggggagtatctaatggtgttggtataggaccaaatatgattactaatgctgtaggtatagctaaggcttatacaacaagagttggtaaaggacctttcccaacagaattagaaaatgaaactggtgaatggattagagaaaaaggacacgagtatggagtaactacaggtagatcaagaagatgtggttggcttgatatagttattttaaagacttcagttagagtaagtggattaacttcattagcagtaacaaagatagatacattagctggattagaaaaggttatgatgtgtgtaggatataagtttaatgatgaagttattgattacttcccagctagcttagaagatttagcaaaatgtgaacctatttatgaagaatttgatggatgggatgaaagtgtagcagaagctagaagctatgaagaattacatccaaatgcaagaaagtacttagaaagaatagaagaattaacagacactagaatttctatagtatcagtagggccaagaagagatcaaacaatgagagtaaaaccattataattggttaacgtgaaagaactatattaacttttaatatagttctttttttcttgaataatattcattatctaagagaagaatactaataagtctaattttaagaggtgaatattatgattgatcaatatacaactttaagtgatataatgtgtgaaaatcccgttgctgcaaatattttaatgagttatggaattcctacatatgctattacagaaaatcaattttctactttatcagatgttgctacaaagtatgggatagatattaattctgttgtaaatcaaatcaatagtggactgactagtttatattaaagatatatttgaaaattatatttatttcatataaaatagttttagtagctattttataaaagaggataggtgatatctatgataactaaagatatgacaattggtgaagtgattaaaataaatgaaagtaaggctgaagttttaatgagttttggaatgggatgcgttgggtgtccatcagctcaagcagaaacaattgaagaagcagcttatgttcatggaataaagctagaggaattgttagaagctttaaataaataatagtataaaagaacccatttaagatgggttctttttagataaaacttttattttttatgatttaataaaggcgggtgtaaaatgggaataaaaacagaaaaagaatatgaaattcattattatgaagtaaactataaattagattgtaaaatgtcatccataattaattatttttgtgatataggaacagttcaatcagagggcttaggtgttggaattgattatttaacagagagaagactagcctgggttttttatagatatgatataagtgtaaaaagatatcctaagtttggcgaaaaaattaaggtaattactaaggctaaaagttttaaaaagttttatgcttcaagagcatatgaaatatatgatgaaaataatgaaaaaatagttgatggagaaggaattttcttattaattaatatagataaaagaagagctgtaagaatacctgatgaccagtatgttgcatatggggtagatttgaatgaaaaatcagatattaaaattgaaaggttagaaaaagtacagcaatcaactaataaagagttctttaaggttagatatggagatatagattcaaatatgcatgtaaataacgttaaatatgttgaatgggcagttgaatcacttcctttagaaattgtattgaattatgaattaagggatcttagtgtggtttttgaaaaagaatgcaaatatggatctgaaataatagcatcatatgaattaagagaagatgaattaagagaagagaatgatgaattaataatattacacaaaatagaaaatgcagaaggtacagaactttcaatactaaaaagtaaatggataaaattaaaaaactaaactgcttagcagtttagttttttttgtgcaattgattgtgcaacagtatagccagagctccaagcccattgtaagttaaatccaccacaatcaccgtgaacatctaagatttcaccacaaaagtaaagatttgaaacaagtttagattctaaagtagtataattaatatctgtggtattaactcctccaacagtaacttgagcttgattaaagtcgttagtaccagtacaagtaaatttccaaccttttaatgtgctaattaaccttttcttttcttgccacgaaagttcatagcaaggtatttgaaggttcataattccacactcttttagtaatacaggaattaattttttattaactacaccaattaatgcattgattactggtctgtgagcaattaatgcaaaatggcattctataaagtcttctaattcttctgttgtataactaggcattaaatctactaaaacttcagttttatttttattaaatatattctgagaggctaaagctgaaatttgaagtataggtggccctgatattccatagtcagtaaataatatttcaccaaaatccttttttataggttcatcattaactaaaagagttgcatatccatcaaactttattcctgataatgcttttaagtgattataatctagctttaattgcactattccaggcactaatgaagtgattgaatgtccaagagattttgctagtttatatccactaccatcggatccagtctttggagcagtttttcctccgcaagctaaaacaacgttgttagctgtgaataatttatattcttcattgcttgtggataacttaaaagatttatccttgtggatatcttttattttgcagcctgtgtataaaggtatatttctatcttctagtgacatttttaaaatatccacaacggaagaagcttgtaaggattgtggataaagttttccactaggaagggcaacaataggaagccctaaagataagaaaaagttttttgtatcttcaagtgataatttttctaaagcacaaaattgaaagtctaaattagagctatggtagttagtaaatggtggtttaatacaattattagatatattacatctaccattaccggtagttaaaatctttttaccgattctatcagttccttcaactatagccacatctattccaaaatctttagcagtaatagcagcgattaatccagaagctccaccgccaacaattattaaatcatgatgcaattaaaacacccctttcgattagtttggagttagtagattagaagttaggagttaatgaataaattcagtatggctgaattttaaaaaatgtattttttagaaacttcatagaagtttaatcattaaactactaactcaaaactactaattactaactatattaatgttttgtattatgttctgcaataataattatgtaattgtagaataataataaatcaataaattttaggaatactaaaaatagaggtgaagttaatgaaagttaagataataaattctaatttagaagattatgataaagaatttaaattaagaagaatgaactatgagcaagtagtagttaattatccaggaagttcagggataaaggtttttaataaagattcagttgagtttattactgagaatgaactagatgagtttctaattaaatatggtgactttttaaaaattaaattaaatagaggaatttcagttactttatataaagctattttagatactatagaagaggaatttgaagttgaatttaaaaaccttaatttgttacgtgataaatatattattaataaaagaggaatttgggaaaaagaaattttatgtgtcatcaatgaaactatacctttaaaaattatggcaagtggccaaaattttaaaaaaagtggttttaatataaaagtagaagaattgaataaagaagaattttttgaaatttgttcttttgaaataaaaaaaataagtaaagaaattaaagaaaaagaagatattttagcgagatatggtatggcaatagaaaaaattaaaaagcctgaaaagcaagtaaaaatgctggtttaagggaaaataaaaatacataataaaaaatatataaaaaaaatttaaaaaaagtgttgacactatatatatttttaggtattataggtaatgtgctcgggagagcgcagcaaaacaaaagaaacctaggccccttggtcaagcggtcaagacaccaccctttcacggtggtaacaggggttcgattcccctaggggtcaccattatattacggaagcatagctcagctgggagagcatctgccttacaagcagagggtcacaggttgagcaacgcccttctaaggcgtgggccaggagttcgaatctcttaacacgcaccagttttggtttactagctcagtcggtagagcacttgacttttaatcaaggtgtccggggttcgattccccggtaagccaccaaaaagaaactcaattgagtttctttttttattctatggattattaacatataaatgttaagtatttagtaaaagctgtggattatatttaatagtatgtggatgaaataccatattaggtgtaaaaaaatagtaataaataaagaatataaaaagaaccgtatcaaatttgatacggttctatatttttacttttcatcatcatcttgtaatgcaccgtaaccttcttcattagttctaatcttaataacattttcaacatcttgaacaaatattttaccatcaccgatcttgccagtgtataaagctttcttaacagttttaactacaatatcaactggaagtttacatataacaatttctacctttaattgtggtaataaattaacttcatctagtggaacacctctatagtaatcagtagaacctttttgcataccgtaacctaaaacgttagtaactgtcataccagtaattcctaatttatctagagcaaccttcaatctatcaaatctatcttgttttgttaaaataactacattagtaaatttagcatcagttttagatgtattataaataactggaactgtatctgtatcatcaattggagtgatttcatgagcagtagaagtagtagcttggcttaatgtaatgccagcatatgaagcacctacagccatgaagtcaggataacagctttcaagaccatgttctttcttgtcaagaccttctatttcttcttctgtagatacacgaagacctatagttttcttaattattgtaaatacaatagtcatagtgatagcaacccaagctataacacaaacaacacctaagatttgagtacctaagaatttaaatccaccaccgtagaataagccaccttcagttgcgaagaaaccagttaaaatagtaccaagagcaccacagacaccatgtacagatactgcaccaacaggatcatcaacttttaatttcttttcaataaattcaactgcaaatacaacagcaaatccagcaaagatacctataaagcatgctcctacagggctaactaagtcacaaccagcagttattgcaacaagacctgctaatgaaccatttaatgtcattgatacatcaggttttttatatctaatccatgttattattaaaactacgcatgttgaaactgcagcagctatatttgttgtcatgaatattttacttgcagtaactattgcttcatctccagtcattgaaactgtagaacaaccgttgaatccaaaccatgcaaaccaaagtatgaacacacctaaagcaccaactgttaaattatgaccaggaatagcatgagcttttccatccttagaatatttacctatacgaggaccaagtattgttgctccaattagtgcagcaacaccacctaccatatgaacagcagtagaaccagcaaagtcatggaagccaagttgtgataagaatccaccaccccagatccagtgaccagaaataggataaataatagcactaattattaaactatatatgcaataagaagagaatttagttctttctgccatggcacctgatactatagtagcagcagttgcacagaaaactgtttggaatataacaaatgcaaaagttgggattgaagagctataatcaccttttataaaaaagtcaaggcctccgattaaagcaccatcgccaccaaacataagtccaaatcctataagccaaaatactactgtacctatgcaaaagtccattaagtttttcattataatattacctgcgttcttggctctagtgaatcctgtttctaccatagcaaaacctgcttgcataaagaatactaaagcggctcctaataaagtccaaattgtgtctaatgctgaatacattaataatacccccttttatttaaagtaatagtttaataagtagggatgatgattatttaaagcttataaaagtctagattttataatgctatcatccttaagtagaatttaaactataactatttttgattttcttattattaaaaatataaaatatggcgtgtattcatcaataggggatatccctaaagtgaaatacacgccattgtgcatttataatatttagttaacgctaaataataattctccgtaacttggaagaggccaatactttttgcttactaaagtttcaagctcatcaaccacaccacgtaagtgttgcatattaataaatactgattctctatagtacttagctgtatctagtggatctgtaatagttttagcttctaatacagatttttctaaatcatcaagtttactatatagatagcttcctagttttgaaatgttgttaagaagtttttcttctaaatcacattgaatattaggcattaattgtttctttccattagctattttagcaatttcaccttgatattcaagtacagctggaataatatattgcttaacaatatcaatcatagttaatgcttcaatatgaagtgttttactatagttctctagtattatttcatatctagaatataattcactttcagagaatacatgatgtttagtaaataaatcaacatttttactgttcacaaagtaaggaagagcatctggagtagtctttaagtttaaaaggcctcttttttcagcttctttaacccaatcatcagagtagttatttccgttaaatacgattctattatgaacttttatagtatctttaattaaagtgtttagatcttcatcaaaattagaactattttcaagtgtatctgcaaattgtcttaattcttcagcaacaattgtatttaatataatattaggtcctgcaattgagaaagtagaaccaagcattctaaattcaaatttgttacctgtaaatgcaaatggagaagttctatttctatctgtagtatctttgaagaattttggtaatacacgtacgccaatttccattgggctcttttcttttgctatataagcagtaccatcttctattgattttaatatttcagttagttcgtcacctaagaacattgatactatagcaggaggagcttcatttgcacctaatctatggtcatttcctgcacttgaaacagaaacacgtaataaatcttgataatcatcaactgctttaattactgcagttaagaataataagaattgtgcgttttcagctggagtatcaccaggttctaataaattaacacctgtatcagtagaaattgaccagttattgtgtttaccactaccatttacaccagcaaagggtttttcatgaagtaagcaagctagtccatgtttattagctatagatttcataagttccatagttaattgattatggtcagttgcgatattagtggtagtaaatataggagctaactcatgttgagctggagcaacttcgttatgcttagttttagctaaaatacctaatttccaaagctcttcatcaagttctttcatgtatgcagaaactcttggtttgatagttccgaagtagtgatcttccatctcttgtccttttggaggtcttgcaccaaataaagttctgccacagaatactaagtcaggtcttttttcatacatttctttatcaactaagaaatattcttgttcaggaccaacggtagtaattacttttttaacattgtcttttccaaataattttaatatacgtaaagcttgcttgtttaaagcttgcattgatcttaatactggagttttcttatctaaagcttcaccactgtaagagcagaatgctgtaggaatacataatgttccatctttaataaatgcatatgatgtagggtcccatgcagtatatcctcttgcttcaaatgtagctctaagtccgcctgatgggaaacttgaagcatctggttcgccttgaataagttcctttcctgagaattccattataatatttccatctttatctggtgaaataaagctgtcatgcttttcggctgtaacaccagtcattggttggaaccagtgagtaaaatgggttgcacctttttctatagcccaatctttcattgcattagcaacaacattagcaacagataaatcaagtggttttccagcttgaatagtatttttaagtgatttgtaagtttcttttggtaatcttgctttcataacattatcattaaaaactaagcttccaaataaatttggtatatctttcataattgtaacccccttcaaataaaaaaaggcaccgtggacaagtaactgtccacagcgcctttgctgtttatgtaagtattatatgtccaaaataatgaaatgtaaatacttttttagaaaaaaattcaaattatttttgatatcaagtttattgataaaaaatagcttatattgtataatattagaaatggacaaaggcgttcatcaaatgttttttagaaatactttttaaatcataagatgtaatcacagttaaattaaaaaaattactaaggattaattattacttatgaataagtttgtagacactaaaaattatttgatggatgcttttttgcgtaaaaaaataggattattataaacagggggaagagatatgtcatatgccgttagagaagttttggagtttgttaaacaaaatgatgttaaatttattagattagctttttgtgatatgtttggaacacaaaaaaatatttcaataatgccagatgaattagagagagcatttgaagaaggagtttcatttgatgcttcagcaattaggggatttggtgatgttgcaaaatcggatttattattatttcctgatgcagatacacttaatgttcttccatggagaccacaacaaggtagggtagtaagatttttttgcgatataaaaactcctgacaaagaagagtttttgtatgatagtagaaatatcttaaaaaaggttgtgaaagtgtgtcaaaataagggatatacgccatacataggaacagaatgtgaattttatttgtttaagacggatgaagatggtgaagcaacttatattactcatgataagggtggatattttgatatagcaccaatggataaaggtgaaaacattagaagggaaatttgcctttgcttagaggagatgggtattaaaccagaaagttcacatcatgaacaagggccaggtcaaaatgaaatagattttaaatatagtgattcacttaatgctgcagataatttcttaaccttcaaatctgtagttaaagctatagctgctaggtcaggtctttatgcatcatttatgccaaagcctataagcaataaaagtggaaatggattgcatattaatatatcattaaataaaaatggtactaatatatttaaaaatgaaaatggacaagaggcagaggttgagagttttatagctggtatattaagtaagacaaaagaaatcacagcctttttaaatcctattgttaactcctatgaaagatttggtaagtttgaagcgcctaaatatatttcatggtcacatcaaaatcgttcgcagttagttagaataccagctgctactggagaaaaaacaagaatggaattaagatcgcctgattcagctataaatccttatttagcattttcattaatactcggggcaggactatatggaatagagaattcacttaaattaccaccagaaataggcgaaaatttatatgcattagatgaagaaaaattacaaggtatagaaatattgccagaaacattagaagaagcgctagacattgcaaagaatagtgaatttattagaagtataataggtgctgatgttttagaaagatatatagaactaaaggaaattgaggctgaacaatataataaatcaatagagaaggaaaaaatgaagaggctatactttgaatatatttaatattattttaacaatgagtaggctgtgaaatatagataatgcaagggggcgtaatttttggatagtattctaatagtatcgagcagtaaaaagggaacgtcattttttactgaagtgctctctcaaaactcctatggggaaattgttacagtaacaaattgtggggaagcaaggagacttttagttgaaagggattttgatttatgcattataaatgcacccttaatagatgaatttggggatgagtttgcaaaagatatagtttctaacggaattgtacaagtaattcttgtagttagaacagatatttatgatgaagtcagtgaaagggtagaggaacttggagtaattacaatagctaagcctatgaatagaactatattctggagtgcattgaaaatagcaaatgctacatataataaaatgtgcagattgaagaaagaaaataataaacttttacaaaaaattgaggatattaggatgattgatagggctaagtgcatattaattcaatatttaaatatgactgaaactgaagcacatagatatatagaaaagcaagcaatggatatgaggtcaactagaaaagttgtggcagaaggaattttaagaacttatgaaaattaaaggaatataattgtttataataatatagtttttcataaaatcggcgtttggtatttgttgattatgatatcatagagtacaaaataccgattttataattatatagtaaaaggtgttaaaataatatatatggatgtaagattataaatgaaagattaataagaagaatatgaaatatataaggtggggtaaaatgcttatttcaattgaggaaaataattttaaaagacaagttgaaattaaatttaataatatttctgatgggtttaataggtataaaaataaaactataagcgcaataaatgaggaagattttgaaaaaggaatgatttgctttttagaagaagcggtaagcttaaacggacttaatagttcttatgttgatttttattataatattttgtcagaagaagatagggataaattagtgaagatgttaagtggggatgatagaaaatttatgcaggaatttaaagataagagtacaggggctggaatttactattatttatccttagatagtattccttttataagtagattaaattcaagggaaatactattttcaactatatatttcactaaagaagaatgtactatatggggaaattataataaaaaatttcctatattttacaaagatgaatgtgtattaatgaaatatattgagatagctaataaatacggattaataatagattaaaagcgagtttgtgtaaaaatgaaaaaataagaaagtaaattgaaaaacactaaaagaggttgttgttgattttacataattaaagaaaatatttaattgtaataataatggtgagaattaagttttatttattattgatattaataaaaaaagataaaaaaggacaattggtaaaaaaaggttgaagaaaaaagtaaatatatgtataatgtatttagaaacttttaaaaggagtatattagtaaagctcatatagggattgaggatggtacggggggatcgagagattatgcaaaatcttttaggattagatagaaaggaccaactagagtattttttcgaaatatcagttgaccttatggctattataggtactgacaagaaggttaaaaaggtaagcaaatgttgtaatgaacttttggggtgggatgaagaagagctaatttcatcggagtggagtaagcttattcatgaagatgatgtacttaaagctttatcatatataagaaattcaaatattaagagtggagttataggtttagaacttagatttaaatgtaaagatggaagttatagatggatggaaagtaattgtaggtatattgaagaaagtaaagtatatatacttacggctagagatataactgaaaagaaacaaattatggaagaaaaaatagcttatgaaaaagcaattgaattagaaagtataaaaagtcaattcttctcaaatatatcacatgaatttaagacaccattaaatattattttagctacaatgcaagtgataaataaaaatattcaaaataaaagtataatttcaactgaaagtgatagtttagatagatatatgaattcaattaaacaaaactgttataggcttcttaggttagttaataatatcattgacataagcaaaattgactatggattttatgatattcaactagggaattataatattgttagtgtagtagaagatataacaatgtctgttttagagtatgttaataataggggaattgagcttgtatttgatactgaggtagaagaagagataatagcatgtgatccagataaaattgaaagaataatattaaatttattgtctaatgcaattaaatatacagaagttgatggtaagatatcagttaatatttattcggataaagaaaaagtatatataatggttttagatactgggataggcattccagaggagaaaattaataagatttttgaaagatatgaacaagttgataataaacttacaagaaattttaatggaagcgggataggattatcattggtaagatcacttgtagaaatgcatgaaggtaggatatgggtggaaagtaaagtaaatgagggaagtaaatttataattagccttccgaagaaaacagtaactgctgaaaatgtaaaaaatacaaatttaacaaagtcaaaagttgaaaaatgttctatagagttttctgatatatataaataaatgtaagcacatagagaaattaatctatgtgcttattttgcgttgtatattttttcgagttcatttttaggagttaataaattaacaaaatagctcataattataactccaggaatatctaagatcaatcgtgctaaagtaaatttaacacccaatgcagaaaattcaaataataatgtagagattttagttaagcaccatgcattcataaaaattattacatttgagaactttgcacctttttttattaacacagctgtaaatgggaatgaggcatacattgggcctgctgctacggagccaattagcattgctagaagtatcccaataattccagatgtattacccatatatttcattagtttttctcttggaacccatacatccattaatccaagcattagcattataggaggtagcactgataacatttgtagtatgtttgaggttacgctattaaatgcttttaaaaataaattatagctaaaaaaagaaagtataataagtaaaattaaagaaataaaaaaggctctatatctttttataaatttaattagtaatttcatataatcatcataatccttcctaataataatcctactataattgaaaaaataaatcccattaaatttctaagaaaagcagcacgcttacctatatatttagcttcaagtggatatgtcattaatccaacaaggacaagagttgatactaaagcacccacctgtgcgtatccggcaccacttgctagtaaagtattacctagtgaaaaagcaacgaatgttggcatcatcgtaactgaacctagaactgctgaaagaattacaccaaaaaatccagagtttgcgcctataatttttgaaattgtatcagcgctaagaaaggctagtaatataccaactgtaattacaataaaaagaaattgaggcataatattttcgaaagattttaaagcattaattaatgctttctttgttttagatttatcctttataaaagatagtattaatagaaaaattgataatccatataagataattgaagtcatattaatctcctgataagtgattttatttatataatatgattaattaagataggatgttataaaaatataattatataaggatagattataaaaaacaaactgcaagaattaatttaattgttgcagtttgtataggggaagagacattctaataataatatttacctttattgtcacttctgtatctagaaatataagaatcaaaattccatttagtaaggaattccttagcacatttatatcctgaattaaatagtgttaaatattgatcttttgatatagcaaaatcaattgtacctatgttataggtacgtatttttattgttctaacggaatctttattatttaaaaactcttcatcactattagctaatatagtatctataaggtcacaagagtaagttattaaattgctattactaggatgatgtttctttaagtcattatcactaagaagctttaatccaaatgtaggccatttcggagtgccttcaacatcaaaaagccatataggaaaattgcttagtattccaccatccacaatataacttgcttctttgccattttttaatataaccggattaaagtaaaaagggagactaatactcattcttacagctttagcaatattaaattccattgggtctatattataattttttaaatcatcgggtaatactataagccttttatttgtaatatctgaggctataaccttaagaggactttcaccatttttggctatatctttaaattttgtttttccttttgctttgtatagagtattaagatattcttcgatgttatttccagagaagagtcctttgtttttaaataaactaactgtaggacctatgaagggaagaagagttaatttatttttttcatagaagtctgtaaagtttatgtttagtaacatgttttttaagtcttttcctgtgtagccaactgctaataatgaacttactatagcaccagctgaagttccagcaaagtgttcaaaagtgtatcctttttcttctaaataataaatcgcccctaataaggcaattccttttactccaccgccttcgcatacgatatcggctttcatgaattcaccaccataatatattaaaattaatatattatatgttttattagaggcaatgttattttttaaaatttaaaaattattccaattaatgctgcgctagcaatataaaaaataggatgttttttaaattttgtaattgcaaataataatataattagtaaaattgtagatttaatattaattgtatctattattttatgggttaagttgaatttatcaaaagctaaaattgatactttaaacacttcataaccagcagatgcaattaatgctgcaacagctggtcttagtccataaaatattgattcaacagcacggctttctttgaacttgtttagaaaatgagcaactataataattactattacagatggtgtgacaagacctaatgtagcaattatacttccaagtattccagaagctttaaagcctgcaaatgttgccatattaacaccaatggcacctggagttgattgtgatactgcaatcatatccataagagttttttgatcaaaccaactgtactttgtagcaagttctgataaaaatggaattgttgcaagtccaccacctacagaaaataggcctactttaaaaaattctaaaaataaagttaaatatatcatttcttttcacctcttaaacttttagcaataaatcctgttagtccagcagctattactacataaacaggtgatagacctaaaaatgtagaaaggataaaagctacaagtgctacgattgcacataaataatctttaattgatgatttaagtagttttactactgtagttataattaatgctacaacagctactctaattccggcaaaagcactttggactatagctaaatcagcaaagttttgaagaaaggctgcaattataagtattattattaatgatggaaatacaacacctagtgtagctacaataccacctataattcctttcaacttgtatccgataaaagttgcagtattaactgcaattacgccaggggtgcattgcccaacagcgtagtaatcaagaatttctttttctgtagaccactttttattttcaacgatttctctttgaattaaagggagcatagcatatcctccaccaaaagttaacgctccaatcttacagaaggtccaaaataaatcaaataattctttcattatgaatgatctcctttgttaaattaataatattattgggactttgttatggaaaaatataattacttataagttccaattgatattatatacttaatttttacaatgtaacagagtaatattggatataagggtaatgttagcataagtgagtagtaatattataataagaaagataattattagatatttaattaaggtattagttaaatatattaataaaaatgctgcatatagatattgttgattaaaacatattaaattgtaacaaaattatgtaaagtgcaaaaatgccaaaatataaaaaaaatatgtattcaaaatagctgaaaataataataaaatgttaaaaaaatattaaaataagtactttttgataaaaaaatatgtacatttaagctatttactaaaaatgtaataatataaaatgcatatattagttgtagttttatagcactttaatcatttcaaaattagattatttgctgtattatagtagtatctagtttttaaaatttaaaattttatatatgaatagaggtgagaataatgaaactagagaataaaatattaaagatgtcagtagtaggtgcgttattctttgcactatttggtattgcttggggatgagcgatagattctgatatgattatattcgatggattatattcatttatcagcgtaattttatcaatgctttctttatacattaataaatatatggctaaaagagattttgaaaaatttccttttggtaaacatattttagaaccaatagttatttctataaaatcattaataattgcaattatgtgtttatactcactaattggagctgtaaaaacaatagctagtggtggtaatagtttagaattaggattagcgcttatatattcaattgtatcagttgtaggatgtatggggatttcttactatatgaaagtaaaagcaaaagcattatcttcggagcttattaaggcagaatgtactcaatggtttatggatacagcattaagtgcagcagtattacttgcatttttatttgcaatgttactagcaaatactaaattaaatttcttaaatccatatatagatccaggaatgacaataattgtttcgttaatttgtattagaatcccattaaaaggatttatagagagttttaaagaagtaatatgtgtaaaagccaatgatgaaataaatgatgatatttatgtattggttaaagaaattgaagaagagtacaattttgaggaatctataacaagggtttcaaagattggacgtgagcttagaatagaaatagactttatttataataaggatagtaagcttaaaactttagatcaaatggataatgtaagagaagaaataaacgatgcgataaagcatattgattataataaatggttaaatgtttcatttacaggtaataaaaaatgggcaatataaagtcagcgaaagctggctttttttattttgatttatttataaattattgaaaataattgtaagagaaaattaagttttaattaacttaatattaattattgtattataagattaaggtggaacttttcaataagtagggaggtctaatagtgtatggaatatattactacgctaacattaaagaataatgtggtaaaatatactaaaaaatgttattatagaataaaatgtaaaaataaaatttactggaggaaaatatggggaaaaaattaaaaaaaataataaccattactttatcgtttacactagctattggcatcacaggttgctcaaaaggtagtggaaaatcttcaatgggaagatatgttgaagaaagatatgagtcaccaacaaatgggtatgctcaaaatctaacaatgttagaagatggaagaattgcaatgtttggttattcagaggaaacagctaaagaaagtacttttatatcagaagatggtggacaaagctggacaaatgaatctatagaattgcctaagcaagaaggaaaggaaacgtatacaaataatattggttatttaaatgatggaagaattttagtatcttattattttgctgatccatatgttgaaccatcagaagatgaaggagaagttgatgattcagtaactacagatagtgaagtaatgactgaagaagattatagctatgaggaaccagagtttacttatgcagttattggaactgatggaactataactgatattgatttagatcttgaatcatataatgatggtgaagagtcatggggatataatacttttaaatgtggacctaatggagatgtatttttctcagctggtagtaacaatgagttagttgttcaatttgatggagaaacatttgaagaaaaatatgtatatgagagtagtgagtatatagatgattttctatttgtaggagattcattaattacaacttcatatgatgcaattattgaatatgatattacaaatggtaaagaaaaaggaaatttaaaagctttagaaaaagaagtcttaggagaaaattccaattattatccaacttttgttaattcaggaagcaaagatacactttactattatacgactttaggtttatatgcttatgatatgaagagtgaaaaagcagatatgattatagatggtgcaatctctacttttggggataatgaaagtcaattaatgggctttattgaaaagggtgaaaagaacttcttagctgtatttagtgattggtcaaatggtggagtatcagttattaattatacttatgatccagatattccttcagttccggaaaatcaattagttgtttattcactattagaaaattatacaataagacaagctatttcaagttatgctaaagaacatccagacacttatgttaaatatgagattgggttaagttatggtgatgggacaacccaatcagatgcacttaaaactttaaatacagaaataatggctggaaatggtccagatgtagtaattttagacggattaactgcagaatcatatatagaaaaaggtttattagaagatatgagtgatataataaatcctttagttgaagatggaacaatctttaagaatattgctgatgcatacactaatgatggtaagatatatcaaataccaacatcttttaaatatccagtattactaggtaataaggaagatatagattcagtttcagatttaaattcattagttgaattaactaaaagactatctacacaaactgataaaagaatatttgataattactttagtgcaagatctttggtttactcattatattatttatatggtaatgattggctaaatgatgataataccataaatgaagaagcgttaaataatttctttacaaaggctaatgaaatgtatgggtaccttcaaactaatgaagaagcatacatgaaaactatggaagataagtattcacaattagaaggctatggtgaagattttgacatgagtgttgatagtgaagaatacatcgatgaagaagttgatgaagagtataatgatgaagattacgaagatttatatgcagtatatgatttacagtattatttaaatccaacaatttatgcagattcattcttgtttgacagatcatcattattagctatgggtggtatggcaggaacttatgattatggaacaatggttactgtattaaataactctcctgaagtgggttataaagttttaactagaggagaagaaaatatatttattccttctaacatagttggaattaatgcaaaaggaaaaaataaagaacaagcaaaagaaatagtagcttcattacttaatggtaactctaatgaaagatattctagtgatggatttagtataaatgcaaataattttaatgaggccttttctattgaaaagatgaaggaagaaggatatgaattagaacttgatgaagcaacaaatcactatactcaaggcacatggggatggtctgatgaatttggaaattcaaaagaagtaaatgtattactacctaatgatgaagatgtaagtagattgaagagtgaaatagaaagcttaaatgttggaacaacagtaaacacagttttattaacagaagttgcaaaacaatttgattcatatgcacaaggggaaatatctttagaggatgctataaatacagttgtagataacttggatttatacttatcggagtaatatggaagagttaaaagaaaataaagtaaaacaattaaaaaaaataggaaaagtaaaaacgaaaaaggttgaacaagaagagtttaagaaaaagacaaaatatacaggtttatattttgtattaccaagtttaataggggtagcagtgtttacactgcttcctttcttagatgtatttattagatctttccaaagtgcaatttcaagagaatttacaggtgtacaaaattatgttgaagtatttaataatgctgcttttaaattagcggcaagtaatacaataagatttgttcttatatgtataccattattattaacattatctttattattagcagttgcattaaataaatttacagaagcatcaaaggtacttagaacagcttttttaataccaatggcggtaccaattgcatcggtagtattaatatggaatattgtttttaatcaaaatggattcttaagtggatttttagataagtttaatattgctggccaagattggatgagtacaggatgggctttttggattttagtatttagttatatatggaagaatcttggttataacataattttatggctagcaggattaaactccatatctaaggaaatatatgaatctgctaaagtagacggtgctaatggtatacaatgtttcacaaagattacattgccttgtttaaagcctactttatatacagttgcagttttatcacttcttaattcatttaaagtgtttagagaggcatatttggttgctggtgattatccagataagagtatgtacttattacagcatttatttaataattggtttagagaattatcatttgataaaatggcagcagcttcagttcttatggctattgtgatatttattttaattatgctattacaaaaagcttgggaaaagcaagattagggtgaggtgatttataaaatgaagaaaaagatattatttattatattagttgctatatctatatttatgtgtttcccagttatatttttattagcaggttcatttatgggagtagatgaattaacatcttatttaggaccagttttatctgaaaagggaaagggatttgtaagctgggggttattgcctagctatccaacattaaaatcgtatatagagttattattagatactccagaatttttcgttatgttctggaattcagtaaaaatagtatttttctcagtagctggacaacttttgtttggaattccagcagcttggggatttgctagatataaattcccatttaagaaaatattatttactatttatatagttgtaatgttaatgccgttccaagtaactatgttatcaagctatttagtattagatacaatgcatttacttgatagtcatgcaagtattatattaccagctatattttctaccttttcagtatttataatgtatagatttttttgtaatataccagagtcaattattgaatctgcaagaatagatggggctagtgagcttgttgtttttgcaaagataggtattcctttaggaatgccaggtataatgtctgcagtagtattacaatttttagaatactggaatttaatagagcagccacttacattcttaaaggataaggcattatggccattatcgatttatttacccaatattactttagaaaatgctgatatagcatttacagcgtctgctgtaacattaatagctgctataatagtattttttgcaggacaaagctatttagagcaaggtattgcagcatcagcagtaaaggaatgataatttatgagtaaaaatgaaaatattaaaaagattaaaaatattataaattttaagtatataaaaaaaggaaaggatactttacaaaaaaaagcagtaaaagctttatttgcttttttggtattgatgataggatgcactatgttatctagagcagcagattctatgactataccaagagttaaagttgatactcctaagtcaaaaacaatagtagatgaggttaaggccaaaggaatagtatcgaaaaatagagaggaaaagatctctgtagttgaaggacttaagattaattatgttaatataagtgttgggtcaagtattaaggtgggagatactttagttgaacttgataaggatgatttacaagctaaagttgatgagattaaaaagaatattgaacaagaacaaaagactttatcacgtgcgacagaagattataataaggccataaatactaaaaagaaagctgtacaaactgctttaaatgaaatgaatacagcaaagcaagtcttagagaattataataattcaggtgaagaagaaaaagatccaagtatggaagaaagcttaaaagctgattatgaatcaaagaaggaaatgtataattcagcagtggcagattctaatgatactgttgatttagatagagcacttcaagatacaaaggattcgcttaaaattgatgagtataataaggaacttgcaaaacttcaacctttactagatgctagtggaaaaattgtttctgaaaaagaaggaatagttactagtgttgtagctgaaaatggaggagttactactgatactatagcatcaattgcagataagaatgaaggatataagttcgttggagaaattgataagagtaatagaacattagtaaaacaaggccaaacagttgctttaaatttaggctcttcaggaattgttgaaaacttaactattgattcgatttctagaagcgatgataatgcagagatgttaaaagttacagttgttttaccagttggaataggtgaaatagatgatagtggagaaataatagtttcaagtaaatcaaaaaaatatggcacatgtgttccgttagcagcattaaggcaaggtgatggagatagttattatattttagttgttactgaaaaggaaactgtattgggagaagagttaactgctaagaaagttgatgtcaaaattgaaaaaagagacggagagtatgcggcagtatctgatggatcaataggaagaaatgataaaataataattgatagtaataaaatagtagaagatggcgatagagttcgcttggagactgaatgataaggtacttaaagcacatagttagaataattcttatgtttgctttaattatgtgctggggaatagctttaggttatgcaaataatatagaaagtaacaataaaactttaaacttttattttgaaaatgataattataatttagaattagtaaatagtataaaagaatcagagaaggagctatctgtagtaggatgggcagaagaatcattacaatctgcaactaacccggatttagggaaaagtgcaagtgaattaaatgtgttagctataagaggttcatctaatttattagttaagggatctaatttgtttgctgatgattttgaaggatgtttaatagataatgatacatcttataagctatttggaagtagtaactgtatagggagagaaatagtttataatgatagaacattagttgttaggggaattttaaagggatctaaatcaaatattattattcagattcctgatgattcgatgcaagtgttagatggtttaacaatagatggtactaattttactttaaataaaatagaggattttaaaatgagatttggaatttcagagttagctattaatggtaatacatattatatgttagctaagtttatatcaatgatattcccaataatcgctttagtattaattttaattaaagtaataagtagcttatttaattcaagaaataaaccagttttagtaggtatatatattcttatggcaatagtctttgtctttgtattttttaaagttacaaatattaaaatttcaattccattggatatgataccaaataagtggtccgattttgacttttggagtaagatgggtaaagaatatcaggaaaagattgaatatatgctttatatgaaaaaatatggagttgatatttataatatagaaaacttattaaaatcagtattatattcaataattacaattatattatttgtaattaatttaagggttataaaaattaaagatataaaagaattaattattaataatggaattttaattattagttcttttatagctgtattaaccatttggtctaaatatgaatttgatgtaaatgtagctatgatatggcttatatatccattgtatctttgtggagagtattttattagagttcatagaaagtatttaatttatgaagaagaagtaaattccgaaataaaaaatagtgatataatagaagaagcggtttgctaatagcagactgtttcttttaattttaatagaattgtatttacggaggaaaaattatgagagatatatctaattctagagggaaaatattcaggcatttcaaaggagatttatatttagttgaggattttgtgaaacattcagaaacccaagaaactatggttttatatagagcattatatggagattgtgggctttttgtaaggccttacgatatgtttgttgaagaggttccagaaggaaaagttaatccaacaggacaaaaatacagatttcaagaatttatagtaaatagcgtgaaatagtgtatcattggagtttacagatgcgataatgaaaaagaaatattcatttcagtataatatttctttttatctatatacatatagtaaattaaatgatatcgaaaactaaactgtcaatgtttgtagcaggaatattaactagtaaaaatttagattggttttaaatacgtatatctgctaatagagaaaaaataaatggattatattaactaatataatccatttatttttttcgttttaccataatatatagtagaataattaactgatatattttcttttatagccttgttaaatttggatttatttataagttttacagtagtactgtaagcttaaaataatcttaaaagttaactaaaaattttatttgtgtggtagacttttagtaaagaatgataatgaaagttaaggagagagaaattaatgaggttattacttgttgaagatgagatacagctttcagaagctcttaatcaaatattaactaaaaataaatatgtagttgatgcggtatataatggtgaagatggattagattatggattaacagatatatacgatgtaatagtattagatataatgcttcctaaacttaatggattagaagtgcttaaaaggttaagaaagagcaatataaaaactcctgttattttattaactgcaaaaggagaaattgaagataaggtaaaaggtttggattgtggagcggatgattatctagcgaagccttttgcaacagaagaattattagcaaggctaagagcacttactagaagacagggagaaattataaatgataatattttagaagttggagatattaaattaaatatttcaagttatgaattagagggaccttgtaatagtataaaactttcattaaaagaattcgaaataataagatgttttatgcaaagaccaaagacaattgttacaaaggatgatcttataagtaagatatggggttatgattcagatgcagaatacaataatatagaagtatatatttcatttttaagaaagaaacttagctatgttaattcaagcactggtatcacaactataagaggtgttggatataagttggaggaaaattaaatgttcaaaaaactaaagaataaatttatatttataaatatgattcttttaactactgtttttgtagggatatttggaacaatatatgtatttacggcctatagtttaaataacgatatgaaaatacaactttgggatagtataatggtggcacaacagcaacaaaagcctaagccaaaagataataagatggacatgtcaataaaaatagacttagatatgaaaaatgaaattattaatgttacttctagattaaatactgattatatggatattaatggaatggttgaaaaggtggttaataacccaaaagaaatggatagtatcaaggttgatggagaaagctatgcttatttgaaagagagtattagtagcggaacaataatagtattaataagtagatcatttcagcaagctgtattaggaaatttattaaaaatatttcttatagtaggagcattaagtttaattgtattatttataataagtatttatttcactaataaggctattaagcccttagaagaaacttttataaagcaaaagcaattcatagcagatgcatctcatgaacttaggacaccattaactattattaaaactaatgtttctatattaaatgaaaataagcaacaaactgtagagagtcaaggaaaatgggttaactatatcgattctcaagcaagtagaatgtctactttgattaatgaaatgttatcattagcaaatcttgatgctaataagaaaaaaggtgaagtaactaagtttgaattagataagattttaagtgatgctttacttgtttttgaagtagtaatttttgaaaagggattagttttagaagagtatataaatgataacgtatttattagtggagaaaaggatcaaattaaaaagcttataagtatattaatggataatgcaattaaatatacaaataaaagtggtaaaattaaagtgtttcttagtgtagaaaagaataaggctagattagaggttaaaaacactggtgaagggatagaaagagaacatttagaaaagatttttgaaaggttttatagagttgataattctagagatagaggaactggtggatatgggctggggctttctatagccaaagcaataactgaagagcataagggaaaaatatatgctgaaagtgttattgggaagtatacatcatttattgtagagttaccagtatattttgaaaagcaaaagttaatcaatgaattaaaaataggaaattaatattataatttttaatttaaataaaaaaactattacattatagaatataattcatatgaaagataattataaaaagagggcaatgaaaaagtgccctttaattttgtctaaattgcatggtaaaaaataggagtaatcagaattgcttctaagggctctctactaaatttttagacatatttgacctgtgaaattatcctaaaattttgatactaaaccaatatttttagtttatcagtggcttcattaaaataggctctttttaatgtgcattattatgaaagaagttaaattcttaagaatttctttagattattataattatcttctttatttttaaatagtattataaaattaatataatgggtaaaggataaatttggagggattaacatatggatgtaaatagtatattggattatttggcacagtatggagtaatatttatatttgtaattgtatttttagaatatttaaacctaccagggcttccagcaggaataataatgccgttagcaggtttatggatatcaagaggaaatatgaattttccatttgttttatttctttcagttattgcaggactaataggaagttggtgtttatacttcttaggtttttatggaggaaactttcttttaaaaaaatatactaataaatttccaaagcagaaggattacatagatgagaagttaaattacttaaaaagtaaaggacatatgggggtattcataagtagattaataccggtagcaagaacaattattgctattccagctggcgtgctgaaaatggacttcttaaaatatactatatattcagcatgtggaatatttatatggaatggagtatttatttcagcaggttatattttaggagaaggaatctttaaatacattagataactaagtagaaataatagaggttataaagttataacctctattatttcgtggattatagtaaaacataataggaaggctaaatttatataagaaaagtgtttaaaattacttaagaaattctttagaaatatatatagttgttatttagttttgaaaaataaaatttatttataataaatgaacgttcaaaaattttaaaaaaagtggggtaaataaaatgaataatttgagctcatacaatatcttggtagtagaagatgaaaatgatatagcaattgcaatagaagcatacttaaataatcaaggatacaatgtctttatagctaataatggaatagaaggattagaattattaaaaaaagaaacttttcatttagcgatagtagatgtaatgatgcctaaaatggatggtataacttttgttatgagacttagggaaaataatgattttcctgtaataatgctttctgcaaaatcagaagaggttgataagataatgggtcttaatataggagctgatgactatgtaactaagccttttagaccacttgagttattagcaagagtaaattcacaattaagaaggtactcaaaatttttaaatatggtaaaagagcctgaagctaaagataatatttatattgttggtggattagaattaaactttgatacaaaagaagttactgttgatgaaaaacctgttaagttaacaccaattgaatttaaaatattagctttgcttataaaaaatccaggaagggtatttgcagctgatgaaatatatgaaagagtatggaatgaacaagcaataaatactgatacgataatggtacatgtaagaaaaatacgtgaaaaaattgaaattaatccgaaagatccaaaatatttgaaggtggtgtggggagttggatacaaaattgaaaagcagtaatgataataaagaatttaatgattctgaaaataatattaatgaaataaaaaagtcaaattataggggtagaagtcttatagcaactttattagttatagcaattatagcaacagcagcattggggatgtgtgcatcatatccattgatagaagaaaatgcaaaaaacgtttcatatacaaattattttgaagaatatgattttatggaaaagttagcatgcactttgtattcttcgtattataattctttaaatgaaaaagcggggggaaccctagacccagcatcaacattattaaatatacaaaaaaacatatatgataataatgaagattacaatgaagaatacaacgaaagtgaatttttaaatgggtttaattctaattttaattattggaatcgaattatagatagtcaacttgcaaatttgcaatattattcttatgataaagctaataatagaacaaaaacaaatatgaattatgaagtaggtattattgaaaataatatagatttatcatcaataaagaaggatgaatatcaattttacgtagctattaattttgatgaaaatggtaatctaacaattaatgatattaagggagctagtattcaaaatttagaatacaatttaaaaattgctttaagtgatttcttaagtgataatgactatgatagttattattataatgctactatgaatccaattaaaaatatggcttttgtatatgcagtgcctaaggatttagtatttaatgattcaatatcatggggaattagaaatgcagaggcatatggatatgaacttgtaggtggggtagcggtaatgataatagctacattagtggcgatagctgcattaatattccctattaaaagagcaaatgaaacacctctatttaaatgggtatccaaaataccatttgaattttggataattatagtatcacttacagtagcacttttgattttatcttctgggtatatgattcatcctgcattaaatgggcaattagaacattttgttggatttaatgttgattggtttactggaacagaaaaggttatatgggcattaaactttattaattggtttatagaatttgcagttgtattctttgctgtgttaataataaagtatatatttaatttgggaattaaagaatacttcaagcgaagaacaatattgggaatagtattaatgttttttattagaattattaaaagaacgttagatgaagttacaaaagtagatttaagagagaaaaacaataagttaataataaaactattagtaataaatgcagtaatattattaataataacttcgatttggttttttggaattcctgtagttatactatattcaatagtcttattcttcgtaataagaaaatatgtagataaaataagcgaaaaatatagtaagttaagagaagctacaagtaaaattgcgcaaggaaaattagatgttaatatagaagaagatttagggctttttgaaccttttaaagaagatttaaaagaaattcaaaaaggtttcaaaaaagctgtagatgaagaagttaagagtcaaaaaatgaaaacggacctaatatcaaatgtatcacatgatttaaagactcctttaacagctataataacttatgcagatttattgaaggatgaaaatttaccagaagaaaagcgtaagcaatatattgacacattggatagaaaggctcaaaggcttcaagtattaatagaagatttatttgaaatgagtaaagcaacaagtggaaatataaccttaaatatagaaaatattgatgttgtagctttaatgaagcaaactttacttgaacttgaagataagcttgaagatgccaatttaacagtaagaaagaacttaccagaaggaaaggtgataatacctttagatagtcagcgtacttttagggcttttgaaaatttagtaataaatatgactaaatatgctatgcctaatacaagagtatttgtagatatagttgaaagtgaagattctgtagaaatagtaatgaaaaatatggctgcagaagaaataacatttaatgtagatacaatagcagaaaggtttgttcgtggtgatgaatcgagaaatacagaaggatcaggattgggccttgcaatagcaaagagctttgttgaacttcaaaatggaaagtttaatataagtgtagatggagatttatttaaagttactattatttttgaaaaataatagtaataaactagaataaaaaataatatgttataagataaagggagtatagttaagtatgatttactatactccctttatagatttataaatagaatgatttttaaaattatactattattaatatgtataattttaaaatactataaatatattacttcataaagaataagacgtttactagtgggggtgggttaatgtcatacaaatatttattagatattgcattaattttattaagtacgaaattattggggttaataacaagaaaatttaatttaccgcaagttgttggtgcattgcttgcgggggttatactagggccatcagtattaaatgttttaaatgaaactgattttataagtatgatagcagagcttggagtaattgtattaatgtttactgcaggtttagaaagtgatataagtaaattgaaaagtgttggtaaatcagcatttattgttgcaagtatgggagtattaataccactaattggaggtaccgttgtagcatatatttttaatgatggaagtttaacaactgttagtgcatttttacaaaatgtatttataggggctatattaacagctacttctgttagtataactgttgaggcgcttagagagttaggtaaaatgagcgaaaaatcagcaaatgtaattttaggtgctgcaataatagatgatattttaggaattttagttttaacagtaataacaagtatggctgatcaatctataaatattggaatagtattattaaaaattataggatttttagtttttacagttgttattggttatttagtatatgtgttttttggaaagtggatagaaagatatgatgtagataagagaaggtttgttattggtgcatttgttatttgtttattaatggcatttatagctgaagagttctttggggtagctgatattacaggtgcatttgccgcaggattagtattatcaagaaatagagaaacttcatatatttcaagaagatttgatataatttcatatatgctattatcaccgatcttctttgctagcataggaattaatatgaaaataccaaaaatgagttttgaaattataataatgacaatagcactagtagcagttgcaatgctaacaaaagtaataggttgtggatttggagcaaaaatttgtaggtttaataaaaatgaggttgtacaaattgggataggtatgatgtctaggggagaggtagcacttataatagctaacaaaggaatgaagatggggattatgaatacttattttttaccagctgttataataatggtaatagtatgtgcaataatcacacctattttattaaagaaagcatatgaaattaaagaaataaatgaaagtgtataattattatatttagtaagaagtaatgatcaaattaaactaaaaataaatattaatacaattaaagtagttgaattaggaattatatattaatttctattcagctacttttttattttaactataatttttacattttagtggaatcatataagtgaaattatagaaaatgcagttagaattgcaacagcacttgcagatgcttttagaactgacgttaatggcttaccactgtcattaattatttcttggtatgaacaaaaggctgtagctgatttattagcattattatcacttggaattaaaggaatattcttaggacctacacttccagcatttttaagtccaaatgttcttcaatatttagttgatacttttgatttaaggagtataagtacagctgaagatgatttaaagacttgtttgaaacaagaaatataatagtgaaatagcataaaggtatttaaatgatagataattatttagatacctttattatataaagaagataatatgtgaaattaaattatttttttaaaaatgtaatgtttgttatgaaataaaatggtaatttactgtatagtaataatataagttaaagcaatattaagaaagatataaagggagtacagtgaatgaaggctatagaaataatgaatgaagaacataagtatattcttagaatgctacaagtaataagaaaatgctgttttaaaatattaaataacgaagaagttatatatgaagattttgataatataatagattttattagaaattatgcagataatcatcatcataaaaaagaggagaaaatactttttattaaaatggtagaggaactaggagaggcagcagaaaaggctgttaatcatggtatgcttgtagagcatgatttaggaagattacatgttagagagttagtttctactttagaaaaagtaaaagctggagaggaagaagcaaagctagatgtcatagcaaatgcaatctcatatacacatgaatagatgctaaaaaaatgaaaaataaaaataattttttaatataataaaaaatgaaaaaaatatataataatatgatataaaattaggggtaaaaaacaaaaaatatgaaatttaaacctctattgtgtaaaaaatagtaaaataaaattatgacgaaaatataagagtggcttagaaaaattaataatattatcaataaaaatgaaacattaataaaaaataatttcaaaattgaatttgtataatttatttacaaaattaaacatttaagttagaattacataagtgaaaaaataaatagataaaagaggaatgtgaaatgaaaaaaagatttatagcaattacatttttattgttgataacttttggaatgatagcctgtggaaaaaatgaaattttaaaagaagaaaatataaatgaaacaaatcaagaggaagtaacagaaaatcaagaacagcaagaagatacgagtgaaattactagcgaagaagagcagaatatgccagaggttgagtatataaacatagcaccagaggaagtaagaataccaattcttatgtatcattcaataagtgatgaagatccgagtaataacttattagttccgcctgcaatgtttgaggaacaaatggcatggcttgaagctaataattttactgcaatgaatttagatgaggctttagaagctatggagactggaaaagtacctaagagacctgttgttataacatttgatgatggatatgcaaataattatagcagtgcttttccatcattaaaaaatcataatttaaaagctacttttttcataattactgatggagtagacaatggttattatatgtcatcagataatttaaaagagatgcaagctgcagggatgtctatagaaaatcatacagcaaatcacttagaattaaatggattatcaaaagaagatgcatatgattcaattaaaagagcacaagactacttaagaaatgtaattggttcagatgggaattatctttgttatccggtaggaaaatataatgatgaaactattgctatagaagaagagctaggaataaaagcagcagtaacaactcaaggaggaatagcttcaataaatgatgggattcataccttaaagagagttagaatatcaccaatgagtattgagagctttgcttcaatattttcagagtatattgagtaaatataagctatactataaatgacaataaaaataatactttggagggatagtagtggcaaaaataacaagtaaaaataacacattattaagagattctagaaataaggtttcacctaaagtatataatcttttaatggatttaattaatgatgataaggaagaattagcagaaattgttttaaaaatagattatttaatagagtatgccaatagcgcagtaaaagcaaaagattatagtgaagcattggaaactattcaaagagcagaagaaagaataaagttaattaaaagagaagattatgatgtaagtcacttagaatacttaattgaaggtgtaaaattaaagattaaaaaataaaacaataccctatagatcttattatctatagggtattgttttatttgaatataaattattttaattatttagaagatcttctgtttctgcttctctttttgttgttagttgaaacttcaacgttaactcttctcttattaatttttccaccagtacatttttcaagtacttgcatgtgaattgcatcatcaacattaacaaatgcgaagttttccattatatctatgtctcttatttgagaagctcctacttttgcattatccttaatgtagttaattaagtttttaatagttaagccatctcttctaccagctgagaagaataatctaacatcatttcctttaactttagctggcgcttcaagtttatcagttgagtaatcaaaagataattgatttttgaattggctttgaagtaatgaagctataactttaacagaatcatgagtttcagttaattgagtagcaacatcaacaaatttagagtaatcttcagcttcaattattgaagaaaattctgctgccattgctttgaacttagcattgtatatttcttcaactgtaggcacttgtcttttttcaatattacccttagtaacgttcttaatttgcttaaggaatccaaattctttaggcgtaattatactataagcagttccttcacgaccagctctaccagttctaccgattctatgaacatatgattcgatatcttgaggtaactcatagttaaatacgtgagtaactccatcaacatcaattcctcttgcagcaacatcagtagcaactaagaattttaaagaaccatttttgaatttagctaaagttttcattctttgaacttgagacatgtctccgtgcataccttcaaccatgtatcctcttgcttgcattgcagcaactaaatcatcaacaccttttttagttctgcagaagatgataccagcagatggattatcaagatctattaatctgcaaagagcttctaatctttgagatccgttaacttcgaagaaattttgtgtaattgtagatcctgtcatttcttttcttgctatagcaatatgttgagcatcatcttttaaatactttttagttaatttctttatttgaggaggcattgttgcagagaataaaagagtttgtctttcttctggaatgctcttcattatttcttccatatcatcaatgaatcccatgtttagcatttcgtctgcttcgtctaaaactaagaactctactgaagataatggtaagtttcctcttcttatatgatctaaaactctaccaggtgtaccaactacaatgttagctctctttaaatccctagcttgaagatgaattggtgcaccaccgtatacagcaacgatgtttaatttttcgtacttagctaattttactaattcatcgtgtacttgtattgctaattctcttgttggagctagtattattgatccaatagcatttcttactgttaaattatttaatataggtaagccaaatgctgctgtttttcctgtaccagtttgagcttgccctataatatcagttccagaaagcgcaactggaattgcttcggcttgaatttgagatggtgtagtaaaacctaaatcatcgatagcttttactaaagtctcttttaagcctaaatcattaaatgttaaattcgtcatatagtatcctctttttcatgtattttttatttattttaaattatttaaataattatttctcatcaatcgactttattaagtatatagcaaaaatataattaatgcactaagtatttattgtaaaatatgaaatagttgtttatttttcgtataatcgagaaatggtaatgttttcattgttgaaaatgaaaattccaaaaaaatataattgacaattgacgaaaaatagttcaaaatatgcaatggaaatagtcattacttaaattttaaatattgtgttattgtgtcatggagtatgtaggaagtttatctacctatatactctatttttttgtaataaaatatgaaattaatattatatttatataaaaggtcgtacaattttaaaattgtacgaccttatttttattaagataatttagatgcaattatattttgtacttttttaggtaattcatcttgttcttctttagttaaagaagttgtttctatagcaggatgaatatataagtttacagtagaaggtttaaaccaaggaccattaccatgttccataactttataagaaccatccatagtaactggtattatagggcacttagatttagttgctaatttaaagctaccagctttaaagtctctcatcggaccacccttacttcttgttccttcagggaatataactaatgaatgcccggcttttaaacacttaattcccctaattatagcctcgcctgattttcttaaattacttctatccatgaatatgcaatgcatgaaattcatccaagttctaactagaggaattttttctacttcaatttttgaaataaatccgataacttcagggatttgagtaatatatataggaatatcaaaattcccttgatggttacctacaaatagtactgtcttgtctttaggaatattttcaacaccatgaacattaacttttactccagctattttcattagtgaattggcccatgtagtagtacatttatatattaatgcttcactttcggctattctattttttttaattaaatatttaactctaaatgtaaatggtatgcttattattaagcttataaaaaaccatatgtaccaaattatagttctaatcataattttgccactcctcaaatttaaatgttaagtaaagtatactataaagtatatataaaaagtaatatttttgaagtaaaaatattaaactaactagcaatagattcatatattaattttaaaattagtttattggggagtaaaaagggtaaatgtttaaatttaatcctaaaaaattaaaggtgatatatagggatgagatagataagaataaattagagtttccgagaaagtatacattaacacatagtgatagaaccggagatttatttttaacaataggtaaaacttatgattataagagtattgattataatataagggatgacgtgttagctttttgggaaaagagtgataaatattatttaaaagtaaagttagaagtggataatggaggctctattccaaagataataataagagataagatatttagagaggagttgccaattgccattaatgctattgtatatggggataaaatgttacttgaaaataataaggttctgtataaggcacatataatagtgtatttcaaatcaaaaaacgaaaaatataatgttatagaagattggggagaaataaaagattataaatatgaggaatagtaagtagaaaaaattgacataaaggagcgagtgtaataaaatatagttatggatcttgctctcatagtttaatggatagaatagtcccctcctaagggatagatacaggttcgattcctgttgggagtaccataataaaaatcgctaagaaatttaaatttcttagcgatttttatttatattattttgatttcttttctaaaaaatcttttgacttttctaatactattattaaggctccacctataataaagaatatccagctgaagcttgaaaggttcattgctggttgtggaacttctaaagtagtaggtcccataaatacggcatataaagagccaagcattaatcctaatattaagtaaatcatagcagatctatatttacttaataagaatttaattattttaattgtacttaaaatacctgtaattacacctagtccaaagattattaatactggtaaataagaaaagttaaatgataaaacctcttttattgcagttataattcctgtgtaaagtccaaatattaataataaagttgaacctgatataccaggtagaaccatagcagaaatagcaattaatccagctacaaatacaaatataccaaggccaaagcttaaattgcttaatgaaagattcatgcccccattagaacctgcagggttaaaataagtaattagaccaacgattaaagcgccgattaaagtaaaaataatatttttatatttacctactaaagaatctttctcttgtttaattattagtggaattgcaactactataaatccagtaaataatgaacttatactatagatatgcgaatcaaatatggaagatagtattagtacagataaaaccataccagttatccaaccaattcctaacttaattaaaaagaataaagcttttttcttatcttctttgctatcttttgatattaatgagtttaatgaacctataaaatcatcatagaaccctaatataaaagcaatagtaccaccagaaacaccaggtacactatcagctaaggccataaaaaaacctctgataaaattaataatatacacaatatcacctcaaaataaatatgttaagtataaaataatactaaaattaaaaaaaataatagcatattattattaaattaatattaaaaattataaagtttttattagaataaaatgtaaaatttatgtttatttattggtaaattatatcatatagtattaacgtatgatataataaatatcaaaaatattttattaaattactaggagagtgatttttttggaacccagtcaagtgtggcagataataatacttataattttacttgtattgtctggatttttttcaatgtcagaaaccgcccttatggcattaagtaaaataagaattaggcatatggtggaagagggagtaaagggagctaagttagttgaaaagttaatagaagacccaaataagttattaggagccatattaataggtaataacatagttaatattttagcatcatcattagcgacaactttatttgtagatatggtaggagcaagtggagttggaatagcaactgctgtaatgaccgtattagtacttatatttggagaaataactccaaagtcaatagcaaaacaaaaatctgaagaagtatcattaaaagtaagtaaaccaataaatataatagttaagatattaaaaccttttataggaatattttcgtttatatcaagtttatttataagattattaggtggagatccgaaagctacagagccatttataacagaagaagaattaagaaccatggttggggttagtgaagaagaaggtgttcttgaagatgttgaaaaagaaatgattttcaatgtttttgattttgcagattctcaagctaaggatgttatggttcaaagggtagatattgtagcagtagatactgaagctacttatgaagaagttttagaagttataaaaacagagcagttttctagaatacctgtatataatcaaactattgatgatatagttggagttttatacgttaaggatttaatcatagcaggtcaaaacaaagaaggatttaaagtttctgattatatgagggaaccttattatacatttgaatttaaaaaaattaaggaattatttaatgaaatgaaaaaaagcagaaatcatttaagcgttgttttagatgaatatggtggtactgttggtatagtaacgatagaggatttaattgaagaggtatttggtgatatagaagatgaatatgacgactataacaaagagatagaagttgtaaaagaagatgaatatatagtagatggaagtgcaaaacttgatgatataagtgaattaattggtgtaaatatggaatcagaagaatttgattctgttggtggattaattataggagagttaggtagattcccagataataaagaggaagtaactttaaacaaaataaggtttgttgttgaagaagttgataagaatagaattaaaaaagtaagaatttacacatagttactaattaaagtaataggtaagagttaagagttttaaatgataaaatgaaattttatcaatggcacttagctcttaaattttagccaataaaaggtggaaatgacataatgaattatatggatattgctctagaagaagctaataaagcttatttaaagggggaagttcctgtaggggctgtaatagtaaaggataataaagtaatagctaaggctcataatttaaaagaaacaaggaagtcagtattagctcatgctgaagtgttagctattgaagaggcttgcaagacattaggtgattggagattaaacggagcggagatgtatgtgacattagaaccttgttcgatgtgtgcatctgcaattgggcaagcaagaatttcaaaattgtatattggaacatttaacaaagatatgggagcatgcggtacaattttaaatattttagattatgatatctttaatacttatgtaaaggtgaattggtgctataataaagaatgtagcgatttaataagcaaattcttttatgagagaagacaaagaaaattaatagaaaaaggggaggataagagatgaatccagtggaaatgaatccagtagcgtttgagatatttggccagcctataaggtggtatggcataattattgcaggaggagtattagttgcatttttagtatcttatattcttgcaaagaaaaaagggctagattttgatattattactgatggtttcttatggagttttccatttgcaatagttggagctaggttttattatgtggcctttgaatataaaaattatcattcatttttagatgtaataaatataagaaatggtggtatggctattcatggaggtttaattggtggattgcttgttgcatatatatttacaagagttaagaagattaatttctttgaatatattgatgtaataatgccaggagtaatattagctcaggcaattggccgatggggaaattttatgaatcaggaagctcacggcggaccggttacagaagaatttataagtaaattccctgaatttattcaaagaggaatgttgataaatggaacatattatcatccaacgtttttatatgaatctatttggaatttagttgtatttgcattattaatatttattttatataaaaagaagcaacaacatggtattgtaataggaagttatatggtactttattctttaggaagattctttatagaagggttaagaactgatagtttaatgttctttggattaagaactgcacaaataataagtttaataggtattattttaggagcagtaattatatttatggctataaaggggaataaatataaaaataaaaattaaatagcataaaagcaaataaatgcgactcgaagtggtaaactaatgttagttataaactgtgagtcgcatttgcagatttatgatgaattatgaaagtaaatctttctattgaactacaataatatttatgttagaatgagaaagtatcaagattaagtaaaataaaaaatattttaattaatgtctaggtatacgatatggagagatgtccgagtggttgaaggagcacgcctggaacgcgtgtataggggaaactctatcgtgggttcaaatcccactttctccgccatagccgtactagatggggagttagcggtgccctataacctgcaatccgctatagcaggattgaattcctcactgaggcttttaatctttctggactgccctatgcaagtgatgttgagggtcgggtcccacgcgacgtaagactgtgaacctcgtcaggttcggaagaaagcagcgataagcagcccctgcgtgtgacgtggatcaatcttacctgagttaactacataggtaacgcttagaggttactgtcaaagtgaggtgtacggttttaaattatcctttcttgctagaaagaaaggcttttttaatgtttataaacaattttaattatcgtgaaaattaattatgaaaaatgatatttcatttttcgttcaaatttattattaaattacggttactcttcaataggattaacaatataggacaaaaaacaataggacagaaaaatagggaaattctttgtgggatatccctatttttctgtccttttttaaatttagaaaggaaaatattaaaaagatatttatttaagttgactaaatgataatataaggatattaaatgcaagttaaaagtattaaaaattgcattttttaaataaaactcttgtaaaatcatataaaaatgaaatataataaaaatatgaaattcaaaaagatttaagggggctatttaaatgagaaaatttccgacttcgatgatgacacaacatcctgataatgtagaacaatacatatcaattcaacatgaaccagaagaggcaatacaaggattaacacctcaagagcaaggcggtcttggaatagacgaaataatgatagattttgaaggtaaattaacaccttatcatcaaacatcacaaattgcattaggtttaattggtaaagatataattccaggtgaaaatgtaagaataacacctagaataccaaatgcaaataaggagtcagtatttagacaattaatgagtataatgtctatagttgaaactaatgcacaggcttatcaacttacaagagtacaagctataagagaagtagttgtgccaatggtagagacagggcaagagatagctgaatttcaagatagagtaaattctgttattgaattaggaaataaaaattatcctgtgaaatttgaagaaaacagtgtaagaataattcccttagttgaagatgttcctgcattagttgatgttgataaaatattaaatgatttctacgagatttcaaaggaaaagggatttaatatagattacttaagatttatgatagcacgttcagatacagcaatgtcttatggcttaatatctggagtactttcagttgtaatggctattgataaggcatataagtggggagatgaacatggggtagaggttgcacctatattaggatgcggatcattaccatttagaggtcattttactggtgaaaatgtagataagatattagaaacttatgcgggagtaaggactttcactttccaatctgcattaagatatgatcatggagctgatgaaactaaaaaggctgcaagagaattaagagaaaagatggatatgtataaaccaagaagattctctaaggaagatatagcacttatgaaggaattcataggaatattatcaaaacactatttaacaacattcttaaaggtaataaatacagtttcatttgtatctgactttattccaaagaatagagatagattaactaaggctaaaacaggattagaatataatagggaagtagctaatctcgataatatagccaatttagtaagtaatgaagaacttaaaaaagaaatattaagtattgataattctactgaatatgcagttcctagagctatttcatttacaggagctatgtatacattaggtatgccaccagagcttttaggaatgggtagagggcttaaagaaattaaagataagtttggacaagaaggtatagataaattaatagaattctatcctatgttaagagaagatttaggatttgcagcaagatttgctaatgcaggtgttagtaaaaagataatagatgaatctgcaagacaagaatataaagaagatatgaagtatgtaaatgagatattagatttaggattagattatgagtttatgaatgataatgaattctatcatacactattaaaaacaactagaccaataataatgcatttaattggattagaggatgatataatccaaagcaaaactgaagagttaaagattcttaatgaatggattataagaatgggtaaagtaagaggaagtattggataaaattaatatttaaaataaaaaagtcggttttaccgacttttttattttagttgaagtattttattttcttattaaatcaataaactgatattttaagccacttttttcacatgtataaatctctgactcaaattcaatactaaattcattaaaatttatttgtggaaaagtagtatctccgtggaatgacttattaacttttgttaaaaatattttatccacagtgtggataacttgtttataaatatcgcctccacctataataaatgcgtgtttagatgaatttttatacatgttgataacttgtgaaaaattgtggataacttctacgttagggttattaacagtataattttcatcccttgtaatgactaaatgttttctgttaggtaaaacacctggtaatgattcgaaagtttttctacccattattattgtgtttccagatgtaattgctttaaatctttttaagtcttctggtatatgccataaaagcttattatctccgcctataacattattttcggcaacagctactataatagatagcattaaacagatacctccatttttattgcaggatgatatttataatctataagttttatatcatctgctgtgaaatcgtagaagttagttatttctggattaatccaaagctttggagcttcatactcgtcattagctctagttaattgaagtttcattccttctacttggttttcgtatatatgtgcattattaattacatgagtaaataaacctggtttaagtccagttacttgtgcaattaaatgaactaatacagcatattgtgatgtattaaatggtacacctaatggtatgtctcctgaacgttggataagcatacaatttagtttaccatctgttacgtcccacatagtcatgaagcaacatggttgtagagtcatatggggtaggtcttctatattccacatagtcataagcattcttctatcctgaggattagtctttaatgtttcaataagcttatcaatttgatggaatttagctatttgataaccatagccacgaccaatagtattattttcatcaacccattcatcccaaatgcggacattttgttcttgtaacttagttacatcattagattgatccttatagatccatagcatttcttttacagccgttttaaatgcaacaaatttagttgttagaataggaaattctttttctaaattaaattgcattacttgatgtggaagcttataagtcggcataccagttctattattgtcgtaatagccattatttaaaatatcttcaactatatttaagtactttttgtcatataaactcatataaatacctcctaaatatataattactattttactataatgaatagatataaaacagagggagaataaaaaaataataagtcgatgaaagtagctatttgtctaaaagttaaaaatataacaaataaatgtaaataaaatacatataaatgttaaaaaaataacaataaaaaataacgacaaaaagatacaaaatgtagatgaaggaaataatatgcataaacaaataataattatgcaatatttaaaattaagtgtccttcgtataaatacacgaaagagttataaattaaatgtaaaactttagaaagtgggaaaaatctttaactattaatagaatttggttataataattaaaggaaactcaacttttatgggtgattgattatgggttgtgtaaaaactactaactaaatctgagatttggagtattaataaaacaaataaactaaattgaaatttataatatagcaatagataaataaaacaaagaaagaggtgattgtagtggcatatacagctttatatagagaatggagaccaaagacctttaatgatgtggtaggtcaggaacatattacaacaacattgaagaatcagatactaaatcataggattgctcatgcctatcttttttgtggaacaaggggaacaggtaaaacttctacagcaaaggtttttgcaaaggctcttaattgtcttaatttacaagatggagaaccttgtaatgaatgtgaaatgtgtagaaagataaatgaaggtttagcaatagatgttacagagttagatgctgcttcaaataatggggttgataaaattagagatattattgatgatgttaaatatccaccacaagaagcaagatataaagtttatataatggacgaggtacatatgttatctgctggtgccgttaatgcatttttaaagacattagaagaaccaccgaataatgttatatttattttagcaacaacagatcctcaaaaacttcctattactattctttcaaggtgtcaaagatttgattttaaaagaataaataatagtgaaataacagcaagacttagaaaaatagtagatgatcaaaatgttattgctgatgaaagaagcttaaatttaattgcaagagtttctgatggagcaatgagagattcattaagtatcttagatcaggcaatttcaatgggaaatggtaatgtagattataacactgtagttagtatgttaggattagttacaaatgagcatttatttaatttaactaatgccgtgatacaaagaagtgtagagaaatgtatagggataattgaagatgttatttattcaggtaaggatatatatttatttataaaagatttaattgctcattatagaaacctacttatggctaaagtaactaataatcctgaagaagtacttgatatgtcagaagaaaatatcgcattaataaaagaacaaagcgctagattaagagctgaagaaataatgagatgtataagaatacttcaagaggcagaaaataatgctaagttaagtaagcaagcaaggttatattgtgaattagctataatcaaaatgtgtaaaatagaatatgatacatctagtgaagttatgttaacaagattaaataagctagaagaaagtttaaaaaatggaagcataaaagtagctgcagtagcaacaggagataataatattaatacggtaaagaatagtattaacaatgtagaaaatagaaaacctgttcaaactaaaactagtacagaaactttaagtggaaattctaattctaaaattacaataaatgatgtacaaaaagcttggagagacatattagaaggatttaaagctaggagagaaatgataataagttctttaattatgataggaaagcctgtagaatgctctaatgggataattactattcaatttgatagtgaaaatgaatttgctaaaaatagattaagtgattctaaaaatagaaatattataaatgaagtttttagtgaaatatttagagaaaatgttaaggtgaattttgtagttgaagaagctaataaaggtagtaaaagcacagaggatattttaagagaaaaaattggtgatgattttattgacttcatagatgaataaatattatagcatcactttattctagtaaatattaaaaaaatactatataataaaaaaatagattttatttgttttaaggaggatattttatggcaagaggtggattccctggaggttttgggggaggaaatataaataacttaatgaagcaagcgcaaaagcttcaaaaggatatggaacaagcacaaaaggaacttgaaactaaagagttcgaagcttcagttggtggcggtgctgttgtagtaaaagtaaatggtaaaaaagaagttttagctataaatataaaagaagaagttgtagatccagatgatgttgaaatgttagaagatttagtgctaagtgcagttaatgaagcattaaagaaagcagacgaagaaacttcaaataaaatgggtaaattaactggcggattaaatataccaggaatgttttaattgataatgggctgttgaaaaacagccttttattaatggaaaaggagtgtaattatggatttttatccggttgctatagagaaattaattgaggaatttgcaaaattgccaagcattggtcaaaagacagcgcaaagacttacactgcatatcttaaacttaccagaagatgaagttaaagaatttgctacagctttagtaaaggcaagaggcactattaagtattgttcggtatgtggaaactttactgataaagacccttgtgcaatatgcggaaatcctaatagagataaaaatgtaatttgcgttgtagaacaaccaaaagatataatgactatggaaaaggttaaagagtttaatggagtatatcatgtacttcatggaaatctttctcctatgcaaggaagaggccctcaagatataaagataagagagcttgttgcaagaatgagtgcagatattaaagaagtaataattgccactaaccctaatgtagagggagaagcaacggcaatgtatatatccagaatacttaaaccattagaagtaaaggtaactagaattgcttcaggacttcctgttggtggagacttagaatatgctgatgaagtaacactttctaaagcacttgaaggaagaaaagaaatttaataagtgacaaggttagagagtgataagttacaagttaatgaataaagtcagcttaggctgactttaaaatttatattagaaactccctaaggaaatttctatcttaacttgttactctcttagtagtgatatgcaacaccaatgctacctggaccaacatgtaatccaattataggacctattgattgaattttaatattagtcatacctaatttatcttgtagtttattggctagttcttggccttctgattcacaatttatatgatgaactattaagccctttattggcgattttgaattctgttccataactgtatctatcattttatctacagcctttttcttagttctaaccttagtaaatacagtagttttaccatcagaaaccgttaaaataggtcttatttgaagtaatgttccaaataaagcagctgcaccacctattcttccacccttttttaaataatctaatgtatcaggaacaaatataaatttactattttcaataacatttttagctatagaaacaacttcatctaatgatttgttatcagcagcggctttagcagcttctaatatagcatatcctgcttgcatgcaattacttctagaatctaacattactatattagcactaggatatttttctaaaatcatttctttgactaaatttgatgttgaaaaagtaccactcatatcagaagataagaatattcctactacgtcatggccatctttgacttgaagttctattgttttataaaaatcatcaatacttggttgagaagatgtaggaattgatggggatttagacatttctttataaaaccaatcattttccaaatctgtttccctataactttttccattcaatagaacattaagtgaaactatagaaacattatacttatctatatattctttcggtaaataacatgtgctatcagctattattcgtatactcaaaaaaaacacctccaatgtaattgacatatttaaagtattataccaaagtattgaaattaagtacagaaaatatactgttaacgatattcaccaaaatagtatataagaagctgcgggtttgaataatatagtaaaaagtggatagtatctaaaataaatgtttttaggaggggcagaatgaatataaaaaatattttaaattttattttagtacactacaaggataatgatacaattgataataaaatattaaacgaaatgcatgaagctattatagaacttgaagtagcagaagctatgtttaattcagtaaatgatccaaagcttatagaggcagctatttatagggaagaggcagcgaaaaaaaaggtagactatatattatcagttgcaaaagagcaatattccaatatgaaaaaagaagctgaagttgaagtcaaagaggagatggaaatataaagaatattgttatataatatggaataatataatactatattatagtctttattttatattgtatagggggaatcaatagatgaacatagagatggttatatacgctttagttggattagctttattatatttaataattaaattattaaaatggccaataaagttattaataaatggaattataggtatagttttattatatgttgctaattttattggcgaatacttaaatttttatattaccattaatccaataacagcacttattgctggctttttaggaattccaggagtaatattcttagtaatttttcaaatgtttttttaaatagaaatagggaatcttcaatagaggaagattccctaaatttatatagacgggagttagaagattttctaaattgccgtaagcgaaaagcttctgcataatacatagtattaaggtttattaaaaagtgttacggttatttaaaaaataaattagggtgtaaacactacatccgtttacaccctttatatataaaaagtacattaaaataaataatgtaccgtctatagtactactttacccatttaacatataaatatgtatgtaaattgttgttaaattaattgtataagtatataattttctaagatataaataaaagtaaatgaattttatttaatttgtatattaaaaaacatagttataacttaagggaggtttcactatgccagcaggaaatggagtaaattgtaggtattgtcctgaatttgagaaaggtagatgtgatggaactgatacaggatgtttatgttacaaatgtccaagacatttaggtcaatgtaaatgtgttaaatattgtagagagacagaatctatattaatttttgatgatgaggaaaataggagctattaatagtagctcctattttttataaaaaattataattattattcaaaaaaatataatcacaaaattaatgtaaatgaaatattataaaaaaataggaagtagtattttaaattaagtcaaattgattatggaaggtacaaaaaaatattaaaaatcaaaaaaataacaaaaaatcctaaggatatagttgtataagttgtaagaaagtagtaaaatatcaaaaagcaataaataaaaatataatatttgggggcaagaaaaatgattagaatattaacaaacgacgggttgcaacaaggggcagttgacaagttagtttcaatggggtttgaagttgttaatactcactatgataaggatgtattaggtgaaactttaaaacaatttgatgtgttggtaataagatctgcaactaaagtaacagcagatatacttgatgctgaagatggtggaaagcttaaattgatcattagagctggtgttggtatcgataatattgatgttaactatgctaaagaaaaaggaatagtagttaaaaatacaccaaatgcaagttcagattcagttgctgagttggttattggacatatgtttgcaatagctagatttttaggggtatcaaattacactatgagaaatggacaatggaataagaaaaaatacgagggaattgagttatcaggtaaaactcttggaattataggaatgggtagaataggtagagcattagctaataaggctactgcattggggatgaatgttgtttataatgatttgtttggaaaacaagataatctttcttatgattttctagagtttaatgaattattaaataaatctgattttatttcattacatgtgccttatgacaaaaataagggttctgtaataggagcaaaagaaattgaagaaatgaaggatggggtatatttaattaattgtgctagaggtaaggtcgttgatgaaaaggcgttattagatgcattaaataccggaaagatagctggagcaggaattgatgtttttgaagaagaaccaacaaagaatgatgaattagtaaaccatcctaatgtcagtgttacaccacatattggtgcagcaacaaaggaagctcaaaatagaattggtgaagaggtagtaacaacaatagtcaattactttgatggtgaggtttctcctattacagctaaatctatagaatctatatagtttaaatagaatatattaaatatatgtagtagatatatgtagtagatatatgtagtagatatataagaggtaagtttaaggaggataaccaatggcaattataaaaccatttaaagcatatagaccagtaaaggaattggcttcaaaaattgcagcattaccttatgatgtaatgaatactgaagaggcttgcgaaatggtagagggaaatgaatattcttttttacacgtagatagaggtgaaattaatttcccaggaaaagttaatatatatagtgaagaagtatataaaaaatctagagaaattttagatgcaatgatagaaaagaaatactatatacaggatgaaaatcaatgcttttatatttataagcaaactatgaatggtaaaagtcaagttggattggtaatgtgtgcttcagtagatgattatataaataatataataaaaaagcatgaaaacactagagctgataaagagcgtgatagaataaatcatgttgattattgcgatgctcatactggacctatatttttaacttatagagaaaattataatatttctaaaataatagatgaaagtatgaaaaaaagtccaatttatgattttatatcagaagatggtaatgggcatactgtatgggtaattagtgagataaaaaagataaatgaactaacaggtttatttaaagatgttaaatacatgtatatagcagatggacatcataggactaaatctgctgttgaagtatgcttaaaaagaagaaaagaaaatcctaattataatggaactgaaggatttaattatttcttagctatagcatatccagatagtgagcttaaagttttagattacaatagaactgtaaaagatttaaatgggctttcaaagtcggaattttttaaggctgtagaggagaagtttacaatagaaaagacattaaataatgaaagatttaaaccagatagtaagcatacatttggaatgtatattgatgaagagtggtttaagttagaagcaaaggaaggaacatttgatgaaaatgatcctactgatagattagatgtgtctattcttcaaaacaatttattatctcctatattgggaattgatgatcctactaaatcagataggattgaatttataggtggaataagaggattaaaagaattagaaaagagagcaaataatgatatgaaggtaagctttgctatgtatgctactactattgaagatataatgagtatagctgatgcaggaaagataatgccacctaaatctacttggtttgagccaaagcctagaagtgggttatttattcataagcttacagaaattcacaaataataaaatatataaataataaaataaagagggctataaaaacaaaatataatgaaaaattggggggacatttttatgtcaagagtatataattttgctgcaggaccagcagtgttaccagaagaggttcttaaagaagcagcaaaagaaatgttagattataaaggtacaggcatgtctgtaatggagatgagtcatcgatctaaagaatttgaagaaattattctggatgcagaaagagatttaagagatttaatgaacattccggataattacaaagtattattcttgcaaggtggaggttcaacacagtttgcaatgattccaatgaatctaatgaaaaatagagttgcagattacattataactggtcaatgggctaaaaaggcagctgcagaagctaaaagatatggaaaggtaaatgagatagcttcatcagcagataagattttttcttatattcccgatgtaagcaagatagaagttagcgatgatgcagattatgtgtatatatgccataacaatacaatctatggaactacttatcatgatcttcctaataccaaaggaaaagtcttagttgccgatatgtcatcagatatattatcacaacctgttgatgttactaaatatggattaatatttgctggagttcaaaagaatattggaccagcaggtacagtaattgtaataatacgtgaagatttaattacagaagatgtacttgagggaacaccaacaatgcttcaatataagatacatgcagacaataaatctttatataatacgccacctgcttatggaatttatatttgtggaaaggtatttaaacatcttaaagagctaggtggattagaaactatgaaagttaggaatgaagaaaaggctaagattctttatgattatcttgattcaagtgagttatttaaaggtaccgttgtaaaagaggatcgatctttaatgaatgttccatttgtaacaggaattaaagagttagatgctaagtttgttaaagaagctaaggaagctggaattgaaaatattaaaggacatagaactgttggtggtatgagggcaagtatttataatgctatgccaattgaaggtgttaaatatttagttgagtttatgaaaaaatttgaagctgaaaataaataataaagtaataaggagttaagtctaatataagacttaactccttaaattttattgaagtttatttagcattgtttttaatataaatgttgagttcttaactccaattggagtgaatttttcaaagtccatatgggctccgttattagcattatcagaaatagatctaataacaacaaaaggtatattgtttaagtaacaaacgtgagcaatacttgctccttccatttcacaagctaatgcttggaattctttttctaaccattgaattttgtctaatgaagcaacaaacatatctccagatactattcttcctgagaatgtcttgaaatcagaagcttcagcacatgcagctttagcagtttcaactaatttttcattacatttaaaatcaaatgtatccattctaggaatttgccccataggatctccaaaagcagtggtatccatatcgtattgaactaagttttcagcaataacaacatctccagggaatatgtcttttccaattccgccagcaacaccaacgtttattacagaagaaacattatattcagatgcaagtatttgagtgcagacagcagcatttactttaccaataccacatactacagcaacaacgttatgcccccataactttcctttgtgaaatttcatctttgctttttcttcaatagtttctaattccatgtcttttaatagaatttctaattcttcagacatagcacctattattcctaaaatcatattaaacctccatgtatgcatatatagttttacataaaatatattatatactttcagttaagtatttaatagtatagaaatataaatatagtgtaaaaacggttaaattagtcacttgtataaataaaggctatagtttaaaataagtaacaatatattataaacagtaaaggagaaactgaagatggcattaaatgaattttgcagaactgaattattagttggtgaagagggaataaataagttacataattcaaaagtaattgtttttggtattggtggagttggaagctttgttgttgaatcattaacaagagctggagtaggtaacttaattttagtagataatgatactatctgtatttcaaatttaaatagacaaatacatgcaacgcaagctactgttggaatggtaaaggtagaagcaatgaaggaaagagttatttctattaatccaaaatgcaatgttgaagctaaacaagtatttatcacagccgataatatatcagaaattatcccggaagatgtggattatgtagtagatgctatagatacagttacatcaaaattagcattagctgaatattgttataaaaataatataaacctaataagctcaatgggaactggaaataagatggatccaagtcagtttagagtttctgatgtgtttaagacaaaggtatgccctttagcaaaggttatgaggcatgaattaagaaaaagaggagtaaagaaattaaaagttgtttattctgaagaaatgccaatgactcctgataagggaagagcagtacaatcagcaaaaagacagactccaggaagtatatcatttgtaccaccagtagctggaatgataataggtggagaagttattaaagatttaacgggaataaaataaaaagtgcacagcaattttttttttttgttagtagttaatagttaaggatgaaactcctagtggagtttcttaaaagatataatttttttaaactcagcttagctgaatttagtccttaactattagttattaacttctaactactaactaaaattttatttttcagtatttttaaatgattaagacaaggttaaagttatatcataatgttccccagttaaattagacagtaagctttctaatgaattttccgcattttttagggcttgtgtatagaaatcagaattattcattttttcactaaacatataattagcatttatatatatttcatttatttcctcggaagaaagctttaaatcaccaaatctaagaaaaccaatctccgtgtcaccatatatagttttattctcatcaatatctatgctgaaaatatctatctttggaattgtaatatatatttctttatttgagttattaacttttatattatcattagatagtgttgaaaaatctattgaataagagcaattagcaaagaaggttattttttttgactttttaaatatatctaaattgaaataagtgttatctacagtcaaagtttcactaagctcaatttctagtggaattaatttatttacgtctttgatttcattaattagtgtatcttcagttaatatttcatgtgattttatatttagggtattaggaagtaatttttttagtttattgggatatttagtatataaaagtattagtgataataatattataaaaagcataagaagtattaatttaaaggttctatatttatattttcttttagataaaaaaataataatccccaccttgaattattgatataattaaattcgcataaattaaatatattagttaaaaggtaatgatattacagtaagtaatatttatatttttgctataaagtttagttgagttttttgttactttgtttgtataataagaatagcttaaaatgtggtttaggagaattagtatggataatcaaaagggagtaaatatagagcttataaagggtacattagatgattatataattaaggataaagataagattgtaataggaagatttacaataactgagctagataaggaaaataaaaagtgcaacttgaaattaaagttctatagagaagataattatgatttattaaagataacattagatgctatattgaaagctgtatttaaagataataatacttttaaggctaatgttacagtaagtgaaaatataaatttaaagccatttttagatagtggatttatattggaagcaatttttacagacaatatattcttaaaaggatgcttttatgatgagttaagttttggaattaatagaaatgactatttatgttcaagtagagctaatatagtagaacttatagggaaaaatgttgtaattagaaactttacaccagatgatgctcaagagttattagaatattatataagaaataaagatcatttaagagagtttgagccggtaagagataatagcttttttacttatgagggacaaaaagagttattgttagaaagttataggcagttaatgactggtgtatgcagcgatttggggatatatttatctggtaaacttattggaaagattaagatttctaatattgtttacggagtatttaaaagtgggatattaggttatgctatagataaagattatgaaggtatgggatatatgaaagaatctataaggttaatattagattacgctaaggattatttagatttacatagattagaggcttctgtattaactacgaatgagagatcaaaaggtgctttattatcttgtgggtttgaggaaataggtcttaataaaaaatatttatatataaatgggaagtggagcgatcatattacattttataaaattctctaaattttttgggaggtgtttattatgggggttaaagtaaggggaaaaagtactgttattaaggctttgaataataacatggtgctggtaaaagatcaaggggtggaaaagattcttttatctaaaggtataggttttaataaaagatttggggatgttttagaagaaaatttagaagtagataaaattttttcaattgaagatgaaagaaatcaacagaatttaaaagaagtttacaatagagtagatggcgaatttattgctatttgtgaagaggctattgctgaaatatcagaagaattaggggaagaacttaatgaatccattcatattggcttgatagatcatttagcagtagcaatgaaaaggttaaaaaataaagaggaaataagtaatccatttattgtagaaattgagactttatataatgttgagtttgaaatggcaaaaaagattgtcaaaaagcttcaacgtaaatataggataaagttcccgcagggggaaattggatttataactttacacatacattcagcaagaaatgggagaaagctatctaacacaataaaatatagttatttagctaatagaatagtaagtcatatagaagagaggttcaatgcaaaaataaataaaagatctcttgattatgctagatttttatctcacataagatttactattgaaagaatattgacagatacggtattaaaaaatgatttaattgacgcaattaaagaatcttatcctatatcttataaaattgcagaagaagtatctaagataattgaaacttcactagataaagaggtaggggaagatgaaattgcatatatagcaatgcatattgaaagatttagattaacgttatgtaaataaaaaatagctaagggattaccttagctattttttatatttattaaacttcgaagttaacaactatatctttaccagcagtaactgatccagattcaactgcatttatagacttagcagcatcaacatttgtaattaaaactggagtagcaagagataatccttttcctaagatgaaatctctatcaatcttaatgattggagtaccagcttttacttttgtaccagcttcaactaattgttcaaaaccttcaccgtttaatccaacagtatcaacaccgatatgaactaataattctagtccattttctaaagtcattgcaaatgcgtgtttagttttgaatactaatgataattctccgtcagcaggagctacgattgtatcaccttttaccataatagctgcaccatctccagccatctttccagcaaaaacagggtctggtacttctgataaaggcattaaatcaccagttgcaactgcaactaaagcagtttttggagtttcaactgaaacagttgtttctactttctcttctgattttccgaataactttttaaaaaaattagccataatatttcctgattataatcagggttcacttcctttctaaaaataagattacacaattttgggtataaaataaaaaggcataagtatatctttattaaagattaacttatgcctgatttaacagtaacacgtttcattataaattatatatttttgagaatagtatgtcaatatatatatatagtaaattattactataataaaaaagcgtgaaaacgttgacaaaagataccaaagtattttataataaatttgtaaaataaattaagttcaaattgtgaggcgtgcaaccataaaaaatgggcattagctgaaaaggatatattatattcttttcagctttttttattactgaaattataaaattaaattattttgctagtcttacaataatgaacaaataaaaaataggggggattttattatgatgaagtacttacaaagactaggtaaatcattaatgcttccagtagcttgtttaccagtagcggcaattctaatgggaattgggtattggattgacccatcaggatggggagcaaataatgtagcagctgcttttttaattaaagcagggggagcattaatagacaacatggcaattttatttgcaattggtgttggtgttgggatgtcagatgataatgatggaacagctggattggcaggtcttgtttcttggctaatgattacaacattattatcatcaggggttgtagctatgctaaaaggtgttgatgtttcagaagtgccagcagcatttggaaagattgaaacacaatttattggtatattatcaggtttaattggagcaagctgctataataagtttaaaaatactaagttaccagcagcattaggattttttagtggaaaaaggtgtattgctatagtaactgctggagcatcaatagtcgcagcattagtattattctttgtatggccagttgtatatggtgcattagtagcatttggagaagcaattatatctacgggatcaattggagcgggtatttatgcattctttaatagattattaattccatttggtcttcatcatgcattaaattcagtattctggtttgatgttgctggaatagatgacatcggtaagttctggggaactaaaccagggggaatattagggcaaactggtatgtatatgacaggatttttcccagtaatgatgtttgggttaccagcagcagctttagcaatgtatcatactgctaaagataacaagaagaaagttgtagcaggattattattagcatcagggttatctgcattctttacaggagtaacagaaccattagaatttgcatttatgtttttagcgccaggattatatttagttcatgctgtattaactggcatatctgtagctatttgtgctgcgttgccagtaagagcaggatttaactttagtgcaggatttgttgattggttcttaagctttaaagctccatttgcagaaaatccactttggttacttgggattggattgatagttggtataatatattatatagtatttagatttgcaattacaaagtttaatttaaagactccgggtagagaagatgatgacgatacaactgaagaaatggatattagactttcaaataatgattttacagaagtagcatcaattatattaaaaggtcttggtggaaaagaaaatgtagtaagtattgataattgtgtgacaagattacgtttagaaattaaagattatacacaagtaaatgaaaagattattaagtcagctggtattgcgggtataattagaccgggaaaaacaaacatacaagtaatagtaggtacgcaagtacaatttgtagctgatgaattaaaaaaattatgcaagtaatagttaaaaactaaataaaaggacgtacagtttaataattgtatgtccttttttattatagtaataaatataagcatacatatatatatgaagtgtttattaagtgaatagaagaggaacctattcaggtaagttaataagagtgatagtattatgaacaggagataagattataaaaatagttaacttagcctggtgtatcaatatgaaataaatagagaataatgacgaaaaataaagaaaaatgctattaaattaatttaatggagaatagtatttaagataaactaagttactgtggtattataaatcatgtcctgagggacagccgataagtcgaaagacaaacttaaaaaaacatcacaacaaaaaaatgttgaaaaagatgttgacaaaaaagtttatcggtgataagataaggaagtcgcttcggtgcgacagagtaaatggtctttgaaaattgaacagaatatagttaaagtaaaccagcaattcttttgagagtcaactaagattaaggatgaattaggatggtatcctgaaactacttttgaagttggtataaagaagactattcaatggtacttagataaccaagaatggatgaaaaatgttacatctggagagtatcaaggatactatgaaaggatgtataagtagtggagaaaaagattagagatgtttttattataggttcaaaaggtatacctgcaaattatggtggatttgaaacttttgttgaaaagttaactaagaagcaagtagacaaaagaataaaatatcatgtttcatgcttatcagataattatgaggaatttttacataatggagctagatgctttaatattaaagttcctaatatagggccagctaaagctgtatattatgatgttttagctttaaaaaaatgtattaaatatattaaagaaaataatattgaaaaacctatagtgtatatattagcctgtagaataggaccttttattgggtactataaaaaacaattaaaaaaattaggaggagatttatttataaatcctgatggacatgaatggaaaagagctaaatggaatgcagttataagacaatattggaaattatctgaaaagttaatggttaaacatgcggatttattaatatgtgattctattaatattgagaaatatattaaggaagattatagtaaatataatcctaaaacaacttttatagcatatggtgcagatatagaaaaatctaaattggctgataatgatgaaatattacttaaatggtatgaagagaaaaatgttagatctaaagaatattatttagttgttggtagatttgtaccggaaaataattatgagactatgattactgaatttatgaaatctaatactaaaaaggaatttgttttaataactaatgttgaaaaaaataagttctatgatgaattaaagaggaaaaccggatttgaaaaagacgaaagaattaaatttgtcggtactgtttatgatcaagagttattaaaaaagattagagaaaatgcttacggctattttcatggtcatgaagttggtggaactaatccctctttattagaagcattggcaactacagatttaaatcttttattagatgttgggtttaatagagaggtagcgttggattcagctatatattttagtaaagaatcgaataatttaagctctattataaataaggttgataaatatgactgtgatgatatagggaaattttctaatggtgctaaggatagaattaagaaattttactcatgggaaaaaatagtgaatgattatgaaaggttatttattgataaggtgtgatttatgaaagtaagtattattgtaccggtatataatgttgaagaatatttacccaaatgtttagaaagtttaattaatcaaactttagaagaaatagaaatattatgtgtaaatgatggtagtactgataattcaagattagtattagaggcgtattcaagaaaaagtagtaagataaaaatattagataaaaaaaatggtggcttatctgatgcaagaaattatggaatggagtatgctaagggagaatatataggatttgttgactcggatgattgggtagaattaaatatgtttgagataatgtacgaaaaagcgaggcaaaacgatgcagatatatgcattagtaattatagagaaatatattcagataatactattaatattaaagattttaataaagagtttactatagtgcatgaggcgagtgtttggaacaaattgtttaggaatagttttgtaaaagaaaaaagggtaaaatttccaattgggttatggtatgaggacaatgcttttacatataaattattaataagtaaccctaagatagtaaatgtaaatgaatatttatataattatagaaaagaacgggctggttcaataatgaactctcaaataaataaaaaaatatatgatatatattttataggtgatgaaatatataagtattctcagaatacttatatttcggaaagtgagaaaattcaattagagtttatatttataagaaatatatttttcagacaagtattaaagataattaagttggaaaaaaataatattttaaaattgagaaaaaaattaaaacaccattatagatatatagagaagaagttccctaattggctaaaaaatgagatattaataaaggatccagatggatattttaacaaaaaattaggtaaaaattatatgttaataataaaaattttaagaattatatagtttattttgatagggagaaataatgaagaattatgaatgtagtatagatgaagttaaggataaaaccttagttttattagatagaagaagtgcgtattttgtatatgataaaattttcaatatgggtataaatgttaatgaaccatataaagaattaaatgtatttccttatattttaagaatattaagaaagatatcatttgtttttaaattgccatttcgaagtatatggtatggagagtggaaaaagacaattgaaaagtatgatactataattttatttgattttttcaacttagatattcttaattacttaagtaaaattcataaaaataagagaattatattttggtattggaatccagtaaaaaaatcagttgatgcaaatttagtatcagatgagttatgtgaaaagtggtcatttgatatgagtgattgtataaaatacaatatgaaatacaatactacctttttctttaatgactataagatagaaaaagagaagtataaatatgatgttttttttgttggaaaagataaaggaagattagagtatattttagaattaaaagaaaaatttgaaaatcaaaatatcacaacttattttcatatagttaatgataaatacagaattagaaaatttaataaattatataataaacctatttcatataaagaagtaattaataaaatttctggatgtaaagctatattagatattttacaagagaatcaagagggattaacattaagagtaatggaatcaatattttttgaaaaaaaacttataacaaataataaagatattataaattatgatttctataataaaaataatatttttattataggtattgataatataaacaatttaaatagttttattaatagcccatataataaaattgatgataatatagttaataaatatgattttaataattggctaagtaggttttttgttcaaaaacaataatatttaaaattgttcattaatatgaagaataaaaacacaatagtttatataaatcttgttaattattatttatatttttcataattagaaaaagttataattaatttctaattattgttttataagagctataaaaaatattatataaattaataaattaagtttttattaaaggagaaattatggnnnnnnnnnnctgggattattgagacttagagaatttgggtataaaagtgagtgttattataccagcatataatgctgaaaaatatataaaatcttgtattgaaagcgtaataaaggatgaattatatgaaaaggagataattgtaataaatgatgggtctatagataggactcaagaaatagtagaaaaattttctcaaaaagataatagaataaaattaatcaataaagaaaatgaaggatcttctgctgctagaaacactggaatacgaaattcaaatggaaaatacatattgtttttagatgcagatgattttataagtaaaaattcacttaaaagattagttgatatagcagaaaaagaaatagttgatgctataatatttgatattgctttatataaagatgatgggaatataaggatattaaaggatggagtttttaatgaaaaaaaatttataactaataaggaatatttaattaatttatttttaggtgaaggttgttcatccatatgtaataaattatggaatgctaaattatttaaggagaatatgattgagcatgcagaaacaatagagtttggcgaggatggtgcaactttaccacaattaatactaaattgtgatagaatggtaaaaattaatactcctttatattactataggataaatttaaatagtaaaatgtatagtggtaatataaaggtatatgaatacattaaatcttataatttagttatcaattactttgaaaataataaaatagaatggattgataaatatagatttacatataaatataatcatgcatattctatgttacatgatacttttttaattagtaaaaaatataaaagaaatgaagagtatagattactttataatgattttcttgaggatttaaaagatgaaaataatatttatataccatttgattcaaaaaaaggtttgaaaaatgaatttctaatcaaagcatatagaaaaaatgtgtacttaggtgaaattataaaaatgtatcaattaattatagaaaaattaaatagtattataaaaatataaattatgaaatttggtgaagtaatgaaagaaaaattgggaattatagataaagcaataatgggatactttttatttcaaatattatttttaagatggatgacaggggtaagttatttttcctatatgggaataataataataatatttgttttagtaagaaaaaaaagaaaatttagattaacattattagacatattaataagttatatatatatattcatagttggtctaaatattttttttaacggtactcatgaattactttttaacaatttatattcagaaggaatagtgaacttaatagcaataatttatattttggttttaagatatgaaaatccaaaagggttaaaaaactatattttaaatgaagtattttatatattaaatatctattttattgtaaatattcctataattataaagcaattagaaggaacatatttttttatgagattaacacaatttaacccaatgtatgaggatcatataacaggtttaattggagctagtggaactcatgagttaaccttttattggattattttagttttgattaatttttataaattttctcagaacagaaaaaaaatgattatagttattaccacgctatatataatttttatgttcataatatcaagtcaaaatgataatactgcattttttattatttttcctttaataatggttcaatattgtttaaaatttgtacttgataaaaagtatattataaaaaatttaattaaatcactatttattattttgataataataggggtatcggtatttatttacaatagtaatgaagatgttaatatatttgttaatactagagtattatcaaaacttgagcaatttgggataaaggatagaaatgttactaatcaaggttctgatgaagaaagaatagcattgtttaaagttgctttagaaaagggagatgggtataaaataggaaaaggaataggtagtattcaaacttatggagagccaacattacctaagcattttggaatgagtgaaatttcattaagaacttatgagggtggactagtatatttaataatacttatattaattttttcacattttttatacaggatatatagacctataaataaagataaattaattgtttatatagcaataactttagatattacgttttttgctatatatacattgatatttaggcaagtatttttttcatttgctttagcattaatagtatttattttcagtttaaattataaagaagaataaataagattttcatagttattatttataaagagttttaggaaggaattaaaataatgaaaatagcaattattacaatgtcgaatggagttaattatgggaataggttacaaaattatgcgatgcaaagagttttggaatcattaggagcagatgtagaaactataataaattatacaggacaagaaataattaatgaaaattcattaaaagaaaaaataaaagattttttagcagaggttaattataatattcctaaatttaaaatagcaaagttagattatattttaagggaaagaagatttaaaaagttcaataagaaaaatataaagcagactgactattttataacaaaggataatataccagataatataaatcaaaaatataattattttgtgtgtggaagtgatcaaatttggaatccagaattccaaataaactcgcatatagattttttatcttttgctgaaaaaggtaaaaagatagcatatgctcctagttttggagtaagtgaattgccaaaggattgcatagataaatataaagagtggataaatggaattgattatttatctgtaagagaagaagctggagctgaaataataaaaaatataacagaaagagaagccgttgtattattagatcctaccttaatgttgaataaaagtgaatggttaaagatagtagaaaagcctaagttgcaacttaggaagaaatatatattgacatattttttaggaagtaaagaaaaagaagttgaaaatagaatacttaaaattgctgaagaatataattatgaaattataaatttaatggatgaaaaaaataaatatatttatagcgttgatccagctgaatttgtttggttaataaataattgtgaattattttgtacagattcattccatggtggagttttttcaataataatgaaaaaggcgtttattatttttgaaagaaaagataaattacaatctatgaactctaggttggaaacattactttcaaaatttaatatggaaaataggttagataaaaatattgttagtaatggacaaatatttaacattgattttagcaatgttgataaaattatttctgctgaaaaagaaaaaacaattacttatttaaagaattcattaaatattaaatagaatgttacggaggatagtaacagaatgaaatcgaatcaattaaaggcaggagtaatattatcatatgtaggaatgatactacaaaacttgatatctataatatatactccaattatgttaagacttctaggacaaagcgaatatggtttatataatttagtttactccgtagtaagctatttaggcttattaagttttggatttggaagtgcatttataagatattactcgagatataaagttaaaaatgatcaagagggtatggcaagaattaatggtatgttcatgacaatattcagcggaatatcattaataacaatattagccggaagtgtattagtatttaatattgaaattatatttaagggtggattaagtattaacgaaattaatactgctaggatattaatgatattaatggttataaatatagcaatatcttttccagcgagtgtattagattctaatattacagcaaatgagaggtatatttttcaaagggttattacattattaaaatccatattaaatccttttttaacattaccacttttattattaggctataaatcaataagcttagttattgttactacaataataactataggaagcttacttatgaacatgtggtattgctttaaaaagcttaatataaaatttatatttaaagattttgattttactttaatgaaagaaatgtggatattttcattttatatatttttaaatatgatagtagatcaaataaattggagtgttgataaatttttattaggtatgtttaaaggaactataggagttgcaatttactcaataggatctcaaattaatacttattatatgacgttatcaacatctgtatcttcagtatttattcctaaagttcatagaatagtatctgaaaaaaatgataatagtctattaacagagctatttactaaagttggaagaatacaatttattattttatcatttgtattaactggatttatattttttggagagtatttcattaacatttgggctggagaaggatatgatatggcttattatatagctttaatattaataattccagcaactattccattaattcaaaacttaggtatagaaattcaaagagctaaaaatttacatagatttaggtctatattgtatttctttattgcaattggtaatattttcataagtattcctttatgtaaaatatttggtggaataggagcagcttcaggaacagcattatcgttaattgtaggaaatggtataataatgaatatttattatcataagaaagttggtttaaatattaagtatttctggaaagaaatttttaaatttatgtcatgtttgattattccagttatgtgtggaatagtaattaaatatttaataggtataaaaaatatttttatgtttattgggctaggaagcatatatgtaataatatttatgttatcagtatggtttattggtatgaatgaatatgaaaaaagcttattggaagaacctattaaaaaaataaaatctaaatttatttcaaggagataagaatgatagaaattacaaaaaaggaagcatgtcatggttgccacggttgctttaatgtttgtccaaaagcctgtatctcaatggaaatagataatgaaggcttttggtatcctaaagttgataaaaagatatgtataaattgtaacttatgtgaaaaggtatgtccaataattaatacgcctaaaagagaggaaagtaattcattgtcatacgcatgcaaaaataaagatgaatctataagattagatagctcatcaggagggatatttacacttttatgtgaatatgttataaaaaatgatggaatagtatttggggctgcatttgacaaggattttaatgtttatcattgttattctgaaacactagaagggtgtgctaaatttagaggatctaagtatgtacagagtattataggtaatacttataaacaggtaaagaactttttaaaagagggaaaaattgttttatttagtggaacaccttgtcaggtatcaggattagatacatatttaatgcaaaaatatgaaaatttaataatgatagatattgcttgtcacggtgtacctagtccactggtatatagaaaatacattgataatattaaaaatttgaataatagtaaaataaagaatatccaatttagggaaaaatctaatggatggaaggattataatttcaaagtgacatttaaaaatggaagctttattcaaaaaatgactgataatatatatatgaaaggctttttacaagatttgtatttaaggccttcttgctatagttgtgaatttaaaaagccaatgacatctgcagatataactttagcagattattggggtgttcagaatattcatcgagattttgatgacgataagggtgtttcattagtattaataaatagtgataaaggtaaagatgttttaaataatatttctgagaagatggatataataaaaacagattatgattttgcaattaataataatccatcaataataacgccagctaattataataagaaaaggggaaggttatttaaaggaatagagagtaatgacatagaaaaagaaatcgctaaatttattaaggtaactatggttgagagagtaattagaaaattacaaaagatagttgaaaaattattatgaatagaaattaaagtatgagtataaataaaaatagtgaagtattaaacaatacttcactataagtttatttatgaaaaatatggagataaaatatgtgtggaatagtaggatatataggtaaaagacaggcagcagatttattagttgaaggtctttcaaaactagaatacagaggatatgattcagctggagttgcaatcatagaagacgaaagaatattagtaagaaaattaaaaggaagattagcaaatttagaaaataatttaaaagctaattcaatcaatggatatataggaattggacatactagatgggcaactcatggagaaccatctgatgttaactctcatccacattcaaatggaaaggcaacaattagtgttgtacataatggaattattgaaaactatatgaaattaagagagtggttaagttcaaaaggatataaattcttatcagaaacagatacggaagttataccaaacttagtagattactactataaagatggaagaaatctttttgatgcagtagttaaggcaacttcaaaattagaaggaagctttgcaattggagttattgcaaataatgaaccagatagaattattgcagtaagaaaagatagtccacttatagttggattaggtgaagatgagagttttatagcttctgatataccagcagttttaaatcatactagagatgtatatcttttagaagataaagaatttgttattttaactaaagatggtgttgaacttagaactgaagatggtgaaaagattgaaaaagaagtttaccatgtaacttggaatgtagatgctgctgaaaaaggtggatatgaagactttatgttaaaggaaattcatgaacaaccaaaggcagtaagagatactttagcaggaaagatccaattaggaaaagaaattgaattagataatgttaagtttactaaagaagaattagaaagctttgataaagtttatatagtagcttgtggaacagcttatcatgcaggtgttgttggtaaaacagttattgaaaagcttgctaaaataccagtagaaatagatgttgcatctgagtttagatatagagatccattaataactgacagaactcttataatagtagtatctcaatcaggagaaactgctgatacccttgcagtactaagagatgctaaaagacaaggagctagagttcttgcaataactaatgttgttggttcctcagtatctagagaagctgatgatgtaatttatacattagcagggccagagattgcagttgcatctactaaggcttatgtaactcaattagctgcattttatatcttaggattatactttggtagattaaaggaaactatttcagttgaaaaagcagaagctattaaagtcgaaatgttaactattcctgaaaagatagaaagaactttagaaatgaagaaagaacttcaaaagtatgctgataaacactataatcacagggatatttacttcttaggaagaggattagattatgcagtagcgatggaaggttctttaaaacttaaggaaatatcttatattcacagtgatgcatatgctggtggagaattaaagcatggaccaattgctttaatagataagggaactgcagttattacattattaactcaagaagctttgaaagataagatggtttctaatgtaagagaagtttctacaagaggtggaaatatatttgcagtagttaatgaaggtgatactataactaaggatgttgttgattctttagtttatattccaaaaactattgatttattaactccaatgataagtgtagtaccacttcaattaatatcttattatgttgcaaagcaaaagggatgcgatgtagataagccaagaaatttagctaaatcagttactgtagagtaatctatttgaaattattaaatgccatcaagataaattgaattattttgatggcattttttattatttaaatctgtggtgaaaatttataacatagtaattcataagggtacatacttgtatactagacaatacaacaattgtataatactttaataataaaatttattataattttaaatagaaaagaaaaactacacaaaataaccaattgaaatcatgtatgttgaaaagtgttgtatatattaaaaacataagtagtagtgtaaatgttataattaaaggtagaattatcactagatataattataatatgctagataaattcagcattatattaatctaaatgataaaaatagatgaagttgaggtaaataataatgggaagaatgtttggaacagatggtgttagaggaatagctaatacagaattaacagcagaattagcttataatttaggaagagcaggagcttatgtattaacagaaggaacacataagccaagaatattagtggctaaagatacaagaatatcaggagatatgttagagtcagccttagtagcaggtatactttcggttggagcagaagctataattttaggggttgtaccaacaccagcagtagcacacttaacaagggaatacaatgctgatgcaggagtaatgatttcagcatcacacaatcctgtagaatataatggaattaaattctttgatggaaaaggatacaagttatctgatgcattagaagatgaaattcaaagagtgatagaatgtggatttgaaggagtaccaagtccagttggtgaaggtataggtagagtttatagggaagaatctgcattaaatgaatacatagaatatgcaaaaagtaccataaaaactgattttaatggattaaaagttgcattagattgtgctaatggtgccgcatataaggctgcagttaaggcttttagggcattaggtgctagagtttacgtaattaatgataacccagatggaaataatataaatgaaaactgtggatcaactcatatggaagaattaatggattatgttgttagaaagcaatgtgatattggttttgcatttgatggtgatgctgatagatgcttagctgttgatgaaaaaggaaacatgattaatggagatttcttattaacaatatgcgctaaggcattaaaagaagatggaaagttaaatgatgatactttagtagtaactgtaatgagcaatttaggattagatattgctgctaagagagaaggaattaatttagttaaaactaaggttggagatagatatgttctagaagaaatgcttaaagaggactatatcttaggtggagagcaatcagggcatattatattcttaaaccataatactactggagatggattagttactgcccttcaagtggctgcaattcttaaggaaagtggaaagtcttttagcgaattagctggagttatgaaggaattaccacaggtattagttaatgctacagttcctaatgataagaagaatatatacttagaagatgaacaaatagttaatgctattaatgaaattgaaggtaaactaaatggagttggaagagtacttataagaccatcaggaactgaaccattagtaagagttatgcttgaaggtgaaaatcaagaagaaataaacgaaatggctaatggattagttgatttaatattaagtaaaatataaaatttgaaattataattacaatttctggagtaaagaaagcaggaaatttacaaagctatgagtggacaaagatgtataaatgtgcaattagtattatcggcaggacaaggaacaagaattaaatcaactttaccaaaggtattacataagatttgtgctaaggaaatggtaaatcatgttgtagatacattaagaaaagcagaaataaatgatgttaatttaataataggtaaaggtgcagagttagttaaatcaaaaatagaaggtagcaatcaggagcttcacccctgataagacgccaacaggtccggcatttcctaagtacaagtacaatgcgtagattaaagaatctacgcatttttttaaaaataaacagcacacttacacaattcaaatatgaaaattgtaaatttcatttggtgaaagcaagtaataatgcaagaatatattactttaaaaggtaaaattgtaaaaatgtaaatatttttaatctttagaattgtataagaataaaaagcatggtaaaatatagataaattaataattaattaaaactatttatacaaaaaacaaaaagagcaaaaatagttggcagctatttttactctttaaattattgaatacaatttgtatacaatataatagtttctaaatatattgtacttcaaattggaaaataattcaatatgattttctaaataggaagtaggaggcaagaagtaggaacccatagaaagttttgttttttataaattaattattaaaatttataagaaaaataacgcccttaaaggaaacgtttccaaaaggagcatgaaggagaaattatgagtcaaacgtttataagcaaaagttctaactatgacatcaaagatttaataaataaggaatattatatagagtctaaattagaagagatctatggaagagaaaatatagaggtattatttttagcttttttgaaatatggaatagggattatagataatttaaagatgaattttccaggacagaatgaggtagatgaaatttggacttttaatgatattgtagttgattttattaattataaagctacggttaaaggagaagatgttaaagtaggagttgttccaattagaatattaaaagtattattgcaatacgaaggaaaggctttaagtagaagccaaattatagatagagcttgggggaaagatgcagtattatgtgatagagcaatagatgtccatattagtgctttgaaaagaaagttaaatttacatttagctattaaaactataagaggagtaggatataagttagaatcttaaacttattgataaaagatttatttataatttaatacagaattaaagtacaagccatgctttgttaattattaaaaagtaataattaataagtatggcttttttctttaaaattattttaactttagaaaataaacaataatttattaagtaaaatgcttcaatttacaattttcacaaaaagggtcttaaattttattaaggatttacaattggttgttacactataagtagagggtaaaaaattaaatataaggggagcagttttatggtcgatatcaaattaatgatgaaggaaaaggaagagttaattaaaagcttagcaattataaaggtaagaaaatatctttctataattgatgaagatgaatttattagacaagcagttgatatttactcaaataagtattactgcgaaattgtagagattttatctcatagggcatttgatgaaattattgaaaggattgaagagttaagacaggcagaatatgatattaaggttttatttaatgacaaggtggaggttaagattagggaatgttttgtaagtaaaatatgtgacatagttatattaagtaaatcaaatatggaagttattaagattttatcaagagaatctgatattataaattcttttgaatctccagaaatgaagttattaggattaggggcaattaacaagtttttaagtcaggtaaatagtgagtttattaaccttacaataattcagcctaatattttaataacatcaatatttagtttaagcatagaggatcttttgcatgatgttgagtatacgttaatgtaataaattagttttgagtatgattgataaaattaagtaatttttgaatagtaacttttaaataagcaattgtattaaggggcataaggataatattaatgctaaaagtttagcaattatattaaaaataaaatatgtaattaactaactgtagctttaattggggaaaagctgcagttagtatatttaagtttttaggggggagaagagatggttaaagttatatctagttatttaagtatggtttttaatgataagaatattaatcgccaggaaaaagaggttttactcttacttaagagttttgataaggatgatattaatagtgtacaagttaaaattaaaactttaattgcctatatggatactacaaatagtagttgcctttgtagaacattaaaaagtttaaaggctaaggggtatttagatattaagacaggtataggaaaatctgctagtatttataagtttattaaagattataaaattgattatgcaaatatttatggtatagagagtttaacctcaaatatgattaatggtgataaattagtaaatacaaatatgcttaatggtaacgaatttgtaagtacaaaaatgtttaatagtaacgaattagtaggtacagatatgactaatgataatgaatttgtaaccacaaatatgattagtggtaacgaatttgtagatacaataaagaatgatatatataataatataaataaaaataataataataaaaataataataaggtttatgataataaagaagataataactatagtaataatagcagaaatataaacagtaataacaaaagctctataaatagtgttagaagaagtagtacaagcagtcataatcataattatgtaaataatagtcttgaagatatatttataaatatattaaagcattggaatgatcaaaatataagtagtattttgcagctagatttaagagtaagagatagcattacttcagcattaagaaagtattcatttgaatcaataattaaggctattagcaattatagcgaagtttattatagcttatatttttatgatataaagtggaatttaaattcttttttaactagtcaaaagggaatagataagtttcatgacaatggttgtatgtggcaaaaatataatgaaaatttatatggagaaaatgaagaggttgaagatgtaattatagataaatatagctatattgatgtttaagtgaaataaaatgtaatgaaagatagataaattgatgtttaagtgaaataaaatgtaatggaatatggataaattgatagaggtataaatggataattaaaaggagaagcttagataaaagtatggtatttaggcaacctgagataatagaaggggatgagaaaatgttagattcaaatcaaattcaattagagcaagaaatattaggagcattattaaataattcaaagcttttaatagttgctatggaaagaataaagtattacatgtttaagtacaagcctcatatgaaaatatatatgaatattttagaaatggctgaaagaaagatggagatagatttaattacttttattaattttagcagaaataatatagttgaaatggatggagtaacttatgtaactgaattaagtacttgttcaaatagtgatgcaggttttaatacaaagcttgaacttcttattgaaggttataaaaggtttttgtatcttgaaatgtgtaataacataaatgaaagtatgtcaattgaggaaattgaaggtgaacttgaaaatactaaggttaatattcataaatgtcaggttaaaaaggaacttgatatagcagctcaatacaatgattatatgaattggctttatgatgataatagaaataagggaataagaagtaatttaactcaaatagataagtatttagggaacttccaaaaaggaaggcttattactgtattcgcaagaagtggagttggtaaaactactttttctattcaaattgcatctaatatggcacttcaaggagctaatgtattttatggtagtgcagaaatgagtgtaaatcaggtttttaataagatagcagcaagtcatttatctgtaagtagtaaatctattgatgatgacagtattttaaaggagcaaaaggatagtatttgtgattttatggttaagttattagaaaataatttttatgtttctactgaaactgatattgataagtttattaatgaaattaagttatataagattcatcattctattgatgttgtctttgttgattatattaataagtatattgattttagtgatagggatattatgactaacaaacttggaagggttagtggaaagcttaagtctttagccatgcaggaagatatttgtgtagttttaattgctcaagctaatagagttgttgataagagaagtggggaaatggctattgagaaaattgatgctagtgatattcaagatagtgccagaatcgagcaagatagtgatcaagttgttgctctttataggaatattaagcttgatgataagatgtataaggacaagctatttaagaagggaaaacttagatataattctagtgatgctgatgaaaatcctgaatgtatgaatgctgttgttattaaaaataggcatggggagaggggaacttgtgctttgaagtggaaagggcagtattcgagagtggagaatttttagcatgctgaaccatgagtttttgtacgatgtatgtagtttttttgcttataaagtataaagtttatctaaacttcttgcattaaatagtagttgactataaaaataaaaaaacatgtttaagataccttattaaaggcaataatttagagaataaattaaataaatagggtaggtataagatgaataataaatacgaaaatatgttaataactttaggggctattattggttcattattaggaactataattatgggtgcaggagtgtacatgatatttaaatcagtaataataatactttttgcaattatcactggattttatgttggtggaattggtggagtaaatattgcaaggaattactataaagaattagttagatatgaatacttatataaaaaagaaaaataacatttaacaataaattatcaaatattaaatacaaacaagataaatatataatttatttaagatattttttagtcatgttattaggaattatttaaatatattaatgttttgtatagaaaaaattaatagttaataataaatatatcaaatgaaatatttattattaactattatttaattattgaagaaaacagtggaaaaagtcgattagaaaacattgacacataataaaataattgtataaactagaataaagaaaacgttttaaaaagaaagtagacataatttaaggcagattttcgaagaaaaataacataattttaaattgattaagtatacataaaatggaatcgtatccagaataaagttttagttataatcataataaaaaacgcacccaataaaattattcaatttatcattaatcaaattgtaatcgtatctaaaatataaggatttatttaaaatagatagtaaataaggggtgtaaagtaaaagatgaggttaagaaaagctataaaaagttttaataatattatatgtgcaatttttttaggaatattatttattgcctttattggaaacgtatccagtaaagttgatgcattatataatttagtaaaatttaaaagctatgtgatagtatctaatagcatgcaaccagtcatagatccaggtgacgtaatatttattaagaaaattaacattaatgatttaaaggtaggggatgtaataacttttgaaaaagatagctttattgcaactcataggattattgaaattcaagaagataaggtaattactcaaggagataataataatatatcagatgaacctatagataaatcaagtattattggagagtatattttgagtattccaaagattgggtatttatattcatttgcaggttcaccaataggaataattgctttaataggagtaatagctatttttattatttatgaattttgttttgttaagaataagaagaatgacaatgataatgatattaagatgtaatgtaagtaaggtttcaaaggggtttaattagttgaatttacaatttgctttaaggtaagttgattcatatataaacaaattactaattaataaaaatttaaatttagggggagaaaattatgaacagaaagagaatcggagccttattaataggtgcgacattactagtaggagcgttagggtcatttgcttattttacttctaagacaggtatagcgggaaatgcaggagaaggggagttacaaaagttaaacattactaatggtaaggtagtaataactgctaaggtagctgatggagaaaatattgattatgactggacatatgatgttgcgagattaagtacaactgaagatggaacaacatcagaaacaataaccgcttttgaagacaggcatagatcacctgatataaatgtggcggatgatgataagggggatgtaaatgacttaagtagagctgttataggagctgcgcttccagcaacagttcactttactaggcctggagatgctgtagttttaggaacagcaaaagttggtggggaagaagctaatggattaataattcaaaatgacagtaatttaactattaaagtaagattaattattaaagacacagatgcagataaagatggaattcaaaacactcaaatagaagcaatgaaagctgcaggctggaaaatgtatataaataatgaaaatgtagatttatcagctttaacagatggtattaatttaggtgtagttggaccagagggaacaatgccagaggttgatataagatttgaattaccaatagatgcaggaaatgaatatcaaaatgctatagctgcaggagctggaaattctgccttagatttaaatcaattaattgaaatccaagctactcaagaaaataatacaagctgggagcaaatggagtaagtaaataatattgcaccgaataacacaccagaagcaactgaataaattattattacttattaaggtttaattaaaatataaattataatataggactatgagttttcttatagttctatattaatataaaagaaagaagggaatatgtgtataaaagtagctaagtatataacttgtttcattacagtatttttactattttctgcagtaaatattcagcaagtaaaggcagaaaagcaagatagtgaaatatataacttagataaagatggatattggaaaccaaaagataatatagcacatgatttctatatcgaaaatatatggggagaaacatgctatttagaatcaatagcatttcaaagaatatctataaaggatgtaggtagtgataagagttacaatatagatgaagcaatttcttcagggataatagatgatgcgtataatataacgattaatgagggggaaaatctattatattcaggagatatttcagatttagtaagtaaagagcacatacctttaaaagaacctatatttttagaactagatacaaaaattaaatttacaatttcaatatattttgatcctttagcaggaaatgaatatcaaaataaaaaatatgaatatttattatatccagaggcttttaaagttgaagaagtatttaaaccagagattagcttaccacaaaccggttcagttataagtagttttactataggtatagtgggaatttgccttattattttaggagtattaatttcattaaggaataaaagaaaagaggtgagataatttgaatcatagaagtattaagcaagtaatattaattttaatattttcaatattaataggaattatctcatcagcaagtgttgcatattttaaaaattcaattaagaatcagccaataactgatttattaattgaatatgaaatacaacaagaataattaattgcgaggtgataattaatgaaactaaaaaaagtagcactagctttatttatagtattaattgctgtaacaagtagtataagttatggatattttactggaattataactgttcaggggaatagtggaggtatgcttcaaaagctggttattactaatggtaacagtgaggttacaatagatactaccaatagtaaatggagttatggaagtttaatcactgaaaatccaatagtagaaacaaggatatatattcaaaagccagatggctggagtgacagtataaatgtttatatatatgatgaaaataataataaaatttcagaatggccaggtataattatggaaaatgaggggggaggattatatagttatacattaaatttaccagaggaatggggaaatgtaacaagagtaatatttaatgataataaaaatcaagtaccagctagtggaagtaatggatttgaaataaaagagggcgaaaaaaagatatataaagataaacaatggtcagactatgaaattaaaattgagcaaccaacaggtgatgtttcaattatagaaaatacggcagtagtaaaaaatccagataataatgttaaggttaattatgatgatgttatagtaaaaaataaatctaatcttatgtcaagaattaagttgagtttagatctttatgctataaaagaaggtggatcacaagaagatagtacaattccacctatagttgatgataatataaacacaacaataccagaaggcgcaaaagattttgaagttttagttggagatattgataatttaaatttaggatataaaaatggtgagaatccgttatcaggaaatgtaatgagtttacacagtttagatgtttttcctaaaaaggatgatccactaggtactgataggaaaatggttactacaggattttataatttttttaatagtataaaggataatgaagataattataaaatcatttattataagaaaaaactaattcagtattctagaaaatggccacttgaatggcaagacttgattagagaaataaattcatctttttatggaatagtatataaaaatgattttggagtctggacacaaccaagtattttttatgattatttaaatgaagatttaataccaaatataattaataatgtgaatatcggtaataaggttggacgtcttaattatacttacaatggtaatgagttacatggtgatagaggagaaatattttatgatgggtatgtagagcgttctattacaaaaacaaatgctgatggtaaagatttcattttaggggaggattatgactcaaaatatattgaattgcaaccagtagagccaattacttttaactattcagataaaattggagataatgaaaaagtatattcagctgtatttcaggttatgattgatgacttacaagcagcagcttctaaagaggtatgggatcaaaagtatgatgatgaagattggcttatatcattttcacctaaatcaaaagctaattataaagttacattaaaggtagtaggtactgacgaagaaattgaagtagaagaattttcacatgtaataaataatttaagtcagcatggaccgagagctaatttagtaactttaaatttacctaataagtattatgaattaattgaaaaaggtaggaaaaatggattagaactaaaaattgatgatactacctttggtacttcaggagatgcttattgtatagattttgctaagttattggtgaatcaaaaggtggagcataaggctgaaatttatggtacggttatagatactgatggtaagcctataaaaaatgcagtggttacaaatagtaatactggagagcaagtattagctgatgaaaatggtaactatagttttaattatgtttcattaggacaaactataattaaggttgagcataggagttatgaaactcaaataaagaatttatatagtatttatgaaggaagtaaaaatgaagttaattttactttaagtagaacttataatgaggaagcaatagcacctaacactaagttaactggaaatgtattgatagaaagatataatagcttagatgaaaagattggtaaaactatattaactgaattgaaaatagttgaagctggtgaagaaaataaggttactatagcaacagaggacttgttagttgaaccggggttttattataaagttaggtatgatttgaatttatttaatatgagtagtattgatgaaaattctaagcagtttaatataaggtttaaaagtaatatatctgctgaaataactcaagaaaataataaatagaaatatattgtattaaattgctaagaaatggaaaatatcataaagattatagcggttaataaaaatatttgcaaaataaataaaaaatattgatagaggtttaatagttggacaatctatttaagaaagagaaatttagagtttcaggcaagtttaactaaccaaattaaaagttgggggctgtcgcattagtggataaaaaaatctgctagcgacagccttttagtgttgcatctaagtaaaacttacttgttgacacgaacgcactaggtctaacattggataataaatcattggtttatcatatattggcaccatttgttttgacatagcctttgttactgggtaaagacgagttcctgatccaccagctaaaataatacctttcatattaaatacctcactttctatttttcacaaatttcatccctataaatcttgctccaaaattaattattgcatctataataattaatggttttttatcttgtatacttcttttaaatatataattaagaaccgtaaatccacgttctccagcactgtattctttaaaatatggattttggtcaaagaactttcctatatcactatatctttttacagtttcattaaaagataaatcatgcgaatgaattattttagaatctgatgcatattcaattctataaccattcatgataagcttatatgcaaaatacatatcttcgttagtaggtaaatccttactatcatatccatttaacttaacaaagacgtcttttaaaacagcacttgatgcatcagaaaagaaaaatgtcataagtcctaacctttcaacatcctctttgctaactattcttgttttatctggatagtttatttctcttgtatatctttcaactttatgattgtcatatccgatttgcctactaaacgctgcttcacatttattattagcaatatctttagttagatgatataaccaatactcatcctcaatttttatatcttgagttataaatacaactatatctccttttgcagcaaatgctgccttttctctaactaaactatgcgaaaagttctctctagaaattttttcgtattcacattttaatttttttaacttttcctcagtgttatcttttgattctgttaaaataaactttatttcctctatacaaatatccctttgtttttttatattaaggtataaatcttctatataagcttctgcattataaagaggacatattatggatattttcatgtacttttcctccgtttttaaacttctttatacagcgccttctcctcttacaacagatccaaaggttttaagaattatcttaaagtctaaccataaacttctattatctatataatacatatccattttaattctttcttcatatgtagtatcgcttcttccattagcctgccaatatccagtaagccctggtacaactgaaaataacttatcagcatattccccatataaagctacttctttttcaactattggtcttggcccaacaatgctcattgttccatttaagatattaattaactgtggaagctcatcaatactacttcttcttaaaaaatcaccaattcttgttattcttggatcattttctaacttaaagtttttataaaactcttctttttgttcctttgtaaaattattaaatatttcctcggaattttgatacatagttctaaatttatatacttttatatcttttccatgcagtccttttctagtatgaccaaatattatcggtccttttgagtctaactttatagcaatagcaacaataagaaaaattggacttaataatattaatcctattaatgatcctaaaatatctacagtccttttaaaaaacagataccattgcgatcctctttttccctctcctatatcattagctctaaaatcagtcatattatcacactccatatgaatctcctattaatattcccttataagtattattatcaaatttctttctaattactatagttttattcataaaaaataatccaacttatattatagtataattttttaataatagataaaaattcatatattctttgcattaacttaactttttctacatttttctcttaatcttattaacattataccttaaatttagatttatttctaatcatagtaatacataaagtaaatgttactatttaatgatattaatgtcaatataaaaggtgcattgtaagtgcaccttaagtaaatcttaatattttaagtcatataattgtattaaataaacttccataactaaaacaaagaatactgataatcctgctatatatggatttgtaatagatgatgctaatatagacattgttcctatagtccatcctactaaaacttgttcatctttcttttctaaagttcttttaaataataaatttaataatttaataaagttaaatattaagtatccaaagaagatcactatacctactatacctgttttaaataataactctacataatataattcaaaactactactactaactggttgtaaattattatcttccatatattgaggatactcatcgatatgggctccaaatccccatcctaaaactggttttgccttaattctatctactaaaaatctaagttgaattgctctaaccttgttagattcatcattttcaaaatctccaatagactcgattctgtctttaatagtcccagatgaattaggtaaattttgttctggtgatacagcaactatagtttttggaagtattactgcaactaatattaatggtattactgaaattaatatattttttaaagttaatttatattttctaaatctccataaataatatgcaaatgctataataactactcctattgttccaagccaaaatcctcttgtatttgatacatatattccaactaaaagtattgctaacttaacaatcccaaaaacgttcttatctttattaaataatttaataaacataaccgctgctgcaagttgcataaaaataccattatataaatacactctagcataattattagacattactaatccactaataaatccatactgtaatttactatttaaattattataagtaactattatttctaaattgttaggtaagtaaattctacttacaaagaataatgtaatagtcatgatagcaactataactgcacaatttacaaacacatttattattttatcaatattttcacttctaccttttacataggctattaaaagtaatatatatattatccctaaaaatgaattaacatctgaaaatatatcacctaagctatttccattaattaaaccaataatactaccgtaagctaaatatatacatacaacaacaattggaactaaaaaccttttttcaacttttattttttctctaaaaatcatatatactgagaatagtgttccaactacaaataatccctttcttataggaagtccaaataaatgtcccagtcctccaagaacaaactcaacaaaaattaaaactgtaactatattaaaaatagttcttatagtatcattttttcccttcatcatcttttctccactctatgcttttattttttatattatttattactttcaaacttgccaaatatattatttttataatcttttattccttttctaatatatttaaacttttctattttattatcttcaaataaaattatttttaaattttctgtaataaatcttcttttgtcagttagtacccacttaggaaaatcttctttatatttatcccagatataatgtctgtttctactcatataatatcttcttaatgcactatggttagttggtatcatagtgacccctaatacttttttcttttcactctctcctaaattatgcactaaaacagcagaattaacttgtagtattttatatccttttttatttaaacttaaacaaaaatcatggtctactaaatcaataaataatttttcatcatacatggcaacatctttatatacttttgctttagttaatgcacctgaagtaatttctgttaatacctcattgtatgattttaaatttatctcttcattaatattactactattattatactctttttcttcaacatgtattggcacaagcattgccacttcttcttttaaattgccattaagcccctcataacaatttaacatattactaatcatatcttcagttactatactatcatggtctaaagttaatatccattcgtattcctttttaatagaatactctattcctttatttaaagctgatgcaatccccttattctcatttaaatatataactgttatttcattttctaaagcttttaacatattaattgtttcattattagatccattatctactactattatttcatcaacttttcctttaagcttattaatacgcaatctaaaatcattttctacattatatgtaataataattgctgcaacactgttcaatattatccctccatgattacaaatcaaataatttatatatttcctcatcagatatctttatattttttaatatttgatttctctttgcttccattaaaggccttttactttttacttctttaacatactttaagcattttctatcaaataacacaaagaatacaagatatttcattactccaatatatattttactcttatctttttcaaaggcataatttgtttcattttttataatcattaaataatgatttctaaatgatattccctttaaaaactctgattggcttcttctattttttatagtgtttattatacccttactactattcatccctcttccatgataagaaattgcatcatgaacgtaataacatttaaatccataaaggtttaatctccaacaaatatctatatcctctttataagcaaagaagtcattatcaaagtattctccatttactttaatcttttctaaagcatctttcttaaaaactgcagccgccccacaaactccaaatactcttttatcttcttcatatttaccttcatctggctcattttgccctatatctattccctttctatagtgattaaaggctataccaaccgaatctataacatttaatttcttatctgtatcaaaatcatactttaggagctttcctgttactgctcctattgtttcatcttctgaaaacttattaatacacttttcaatataattttctccaaacacgatatctggatttgctattattacataatcaccttttgctagctctattcctttattagcccctcctgcataaccagtgtttttatttttaaataatataacttcttctttaaagttatcttcaataattttcactgaattatcagttgagccattatctatgataataatctctatatttttatatttttgctctagtaatgattttatacatttatataagtacttttcaccattccaattaactattgctactgaaactaatttattcatatataaacttctctcttcctctaactaaatagcattatttaatcttattaactatttatcataattttcattaccactatattcatcaataaaatataatggtctatttttaacttctataaatattcttcctaagtattcacctattatgcctaagcaaactaattgaattccacctaataatagtattatacatactaagcttgcatatccaggaacatctacacctctaataatagtcttaaagagtgtaaataccatatatccaatagcacctattgcacttaccattcctattatagttgcaattcttaaaggagctacagtaaatgaagttattccctcaattgctaaatcaaataatttaaagtaattccactttgtagttcctgctactctaggatctctatcaaattctattgccttctttttaaagcctattaagctaaacatccctttagtatatctttgtttctcagggaatgatttcaatgcttcaacagctcgtctacttaataatctaaaatcgcctgtgtcttcttgaattggcactgatgatacacttcttagcactctataaaatgaatgagatgtaaatttctttaatgctgtttcaccttttctgcttctacgctttgcatatacatcatcataaccttcttcataatacttaatcatatctattattaattcaggaggatcttgtaaatcggcatctattattgccactacatcaccttttacataatcaagagctgcggccattgctatttctttaccaaagtttcttgataaatttaaataacatactctagaatcattttccttatattgttttactatttctaatgatctatctttacttccatcattaacaaataaaaattccatattataattaggaatattttctgaaagctttactaatctctcatacaaataaggtaaagattcctcttcattatacattgggattattatggatattaattccttcataattttatattctcctttaaatttagtctaaaatcttacgtacatataacataaaactatttgcacataaaattataaatactaatataagataaatattagcacgccattttctcagaaactcatttagtattaatgcacttattacaattattaatatatctgtaacaaaaaacactcttgctcccgatgcatatatagttggtgatatactaattgatagcgacgaacaaattgccgctaaatataatattactgataagtactgcatttcaattctatcaaatataagtaaaaacatcactggaattattaataatgtacataataaaatagatgttggtaaaaataatttaatattatcaaagtttaatatatttaaattttgaacacttaataatttaaatataaataaatttgtactaatattaagaacttcgaatactctttctactatttttataataacaactatcataggtattgctgctaatagtctaattaatacatctttgtattttttccaaattaatatatttattagactaactaatacagcaattaatataatttcatttctaaacatatgctctaagaataaattagttcccatcattattttagttggtaatgaaatcatatcccattgtccaaaccatgttattgtttcattttcagatcttgcataatttcctggcgctaaaaataatattgcagtattaattgctataaatatattgaaaacaactaaatctaatcttacccttttatctctaataattaaataaatattcgtaatcagtgcaaaacaaagtattactaaagatgcttgttccatattagcccctaaaattgctgcaaatgctaatacaatataccaccttttattaaaattctcgttaaataaagcacttttaaatggcaacataactataagtgcacatgctaccggccataaataattaaacgaacctgttatccatgaaattgctgttaaaaatacatccttatgtatagtaaatatagaaatgcaaattatacttttaattaataaccttttaccttctgtcatttcatctacatatttgtatggaattaatctatatattccaaatgctaaaacaacagtcattattgtatttaaaactctccataaccaaagattacatccaaacataggtaccataatagattctattactattcttccggtccagcttgtatatctatgctgtaaataatctattaaatttccattaaaagcatcgtttaaaattgctgaaaaccattcatcatctccaggagttactgttcttttagcaaaaactaataacattaataatgctaatatgaagtatggaatattctctattttaaatatcttattaaatatttttttcatattcatcatcctaacttatctcaataaatttatctgtaaaaatcatcttttctcgttcatcctgattaactataataaatccaatttgatacttttcgccttcaataagtttatcattattaactctacctataagcccacatttaatataattagtttcaactgtatttttcccctctaaatcttcgcgttcttgcatttcagtttttatagaaataatatttccactttcatcttttaaaacaatctttctatttatatattgatttgtactattagtttctgcaagccatccagttattacgatatccttatcgtaataagcaacatcttcaatttcatattcaaaatctgcatcgtaattattttctatacttttcacttctttaaccttttcaaagtcatatttaacaagaaaataacttccaaagccaacaatgacaactaaaacaaatagcaccattactattccttttttcatcaataatattctcctcatttttttcttttggtattatttctccttaaatacccatattttatttactatgtaattaataaccataacaatagctgtagtaataactagtcctactaatttattaaatgataatatatcaactaagaaatataatatagccgtgtttaatgctagtcctattaaattcaaaattataaacttagctgttgtttcctttttatcttcaccattatatttaaatacccatttggaattccaaatataactgtttgcagttgcaataacataagcaataacatttgcaacaatataatatactcctacaaagtttaataacgcaaatattatccaattaattaaagtatttaaaactcctacaagtccaaattttataaatttatttattccactttccaaaaaattcattttttactccttttattacttaattagattatttaatacattattcaatattatacacttataacatgttctttatcaatttataattaactatatataaactttttaagtaattcttaacaattaagtgagattctaaatcttagatttagttaatcgaacttactcagcgactgaaaggagtcgagtttcctttacaaaattctaaatcttagatttagttaatctaagttaactcaaactccaaattttaatttggttaaagatacaatttagtataccacgttctgaaatatccttgaattttcttttaatcctcttaattttattaaaataaatcaattttttctttttaaaaattaaaaagtggctaatgccacttttttaaatttaaaaactaattaataattataatttttctactttttcttaatcatagtcataactctatttatcatttctctttgaatatcatctttaattataaacattatgcctatgtaaattacaactcctgatataccttgaactacattagcaagcattccattacttatgctattaccaataaacgtaactactattcccattattatagaaacaacaacatatttaactatccctagtagcattctcacaacaggtaattgctttcttactaatattaattgaattactattcctatatattctgctgcaattaatgatattattgccccagctgctccatgcttcggaataagcactatattcataattaaatttattatagcagcaattattattgataaagtatatttattttcctgtttaattgcaatcaaatattgcactcctataatgttagcccaacttacagcaattataataagcgaagtccaagctgttagttgtcctactggtaagtatttaggcgctaaaaaccaagaaactaaaatcttagatatacacataagtcctatagacattggtattgccatatatgaaacaactttaaatgttttttctataattttaggaacttcttcatgctttccattacctatgatattagatactcttggcaataatactacccctattgatgttatcattgctaaaaccatattaactattttttgagaatagtcatagaatattacctgatcattagttgatagaaaacctactaaagttcttgctactaatgtataaacttgtgttgctatttgaggtaaaaataatcttaataatggtcttatagttctttttactatttttttatctataactatctttcctacatatctaggaacgtaaaaccacattaatactatacttactatattaactactactgttaataatgcataaagtaataagtcatctggactctttataaaaataaatatacatgcaagtccaactaatctagcaaaagtatttcttattactacctttttaaaatcttcaagccccataaataaccatgatatatctatcataactgaaattatatttaatccttgtattaaatatatagttgtattactattcgtaaaacaacctataaataaataataagctattaatgaaactgtacttgttgctagttgtacactatataaactccagaaagtttttgctaatttttctttatcatctcttacatatgctatttgcctattaccgtacatctgcattcccaatgcaccaaataacataaagtaatttgctatagataaacttagagaatttaatcctaattgttctggatcaaacactcttgtcaaatatggcattgttataagtggaattagcatgctcattatctgataagcagtattatataaataattttttattatactcatcttctctactcctataaaaacaaattaattaaactctttatactctatctttttagcttctttatttccatccttgatacccttaaaaacggattttaaaacttccatattgaaattctttaaaagatttataattaatattatgtaatatgttttttttgcttttttatatttttctaaagattgatttctttttgtatacataaatagatttcttgctaaataatactctttaaatccacttgtcttattccctgttgcagaatgcatatgataaacaatactttctttaagtacagttgtcttaaaaccagctctttttaatcttaatgataaatctacgtcttcataatatgcaaagaatttgctatcaaaataatctccattatcaagcttaaccttttctaatgcttttgctgagtatattgctgcccctgcacaagctccttcaatagttatgtctctacctagtacttcgtttacttcttctctgtatccaacttgacttggaattaacttttcattaaatactaatccagctgcatcacacttatttctttcaaagtaattaatcataaataattgaaacacgtcatattccttattatcttcaataaactttattgctttagataaagaatcactaggaacttcaacatcattatttaatgttaaaacataattgcatccttcatttattgcctttttaattcctatattattagcaggagcaaatccgctattatgatccatttctactaaatctatatttaatttttctttataactgttaattatattaatggaattatccttagaatcattatcaataatatatactttaaaatccttaaataactgattttctaaacttgaaagacatttatcaattaacttttcaccattccaattagcaattactataccaaccatcttttttctccttgcttattattctattttagcttacctctaatcccttttttataatctttatatcctctaaaaatcatttttattttattaactttatccttttctccaagtacaattttcacaaattcctttttaaacagcattttatctctatttaatgtaaaactatttaaatctttgtacttttcccaagtataaaatctatttctagtcatataatatcttctaatagctgaatgattagatgtgttaaattttaagaatccactttttacagcctggctttcacctaaattatgataaagtatcgcatctctaacctttatcatttttatatttttttcatttaatctcatacaaaaatcagtatcaactaagtctataaaaagactgtcatcaaagaatccaactttatcaaaaatttcactttttaataaattacctgatgttatttctgcatcaacatattcataagcttttatttctgaattttcctctatagactgtactctttcatcaacaaaattagggaatatacttaatatgtcctttctttcctctaagtttatatcttcatatacttcaaacattttttcaatcatgttatcatttgccttactatcttggtccatagtaataacccagctataatcttcatttaatgctttttttattccaatatttaatgctgtagctattcctaaattatcattatttaaaattaagtctaccttattagtatttgaattttttaattcttgtaaaatctttatcccatctctattagaaccattgtcgacaatgaacattttatcaacttgatttattaaagaattaaaacattttgttattcctttatcaggattataactaactataatacaagctaccttattcatatttactccttaactaacaaatttaacaatatttatcacctttcataacaatactttagattataacatatattttttttaacttaccatacattttgtatgaatgtttttaatttatacataataatttaacattttctatgcattatttaacattgtctaatattttcttaacatttataatataattattagataaacacttcattcacaaggaggaaagatgataaaaaaattatttgataaaaaaagcttattaaatatattattatttgtaatttattctttacttttagtatttttaatagaatggatatctaggggtaattttgctgacgcatatgagttcttccgtcatcaatttagtaaatttacttataatgtattaattgttgctttaaccttaagtccttgcttcttatttagaagaagacttttcgcttttagtacaggctctattatctggatagtcttaggtatagcagataatttagtaattaaatttagagaaactcctctaacttatgcagatttagggatggttagcagcgcttttgagttgattactcagtatttatctaagaactcattgatattaataattatttcatttatcgtcacaatattaatattaacagttttattttttaaatgtaaaaaaacaaaagttaattacctaagaaacattgtatgtttattagtatttttgttaacgttttccagctctattgattatggtttaaaaaatggtatcattacaacaaacttttgggatgtaacatgggggtatggtgcttatggtttttcttactccttttacaatagctttgtaaatactggaatatctaaacctagtggttattcaaaaagtacaatttctgatataaccgatactttagctactttagatcctgaaaattctgattctataactacagtagctacctctataagtagagatgttgatttgttagatgttgatcttacttcacaagctagtgatactcttgttaaaccaaatattataatgattcagcttgaatcatttataaatccaaactggttaattgatgtaacttttaatgagaaccctgtaagtaattttgagtactactctgaaaacttttcttctggtttagttactgtacctgcaatgggagggggaactgctaatacagaatttgaagttattacaggtatgtcaactgaattttttggtgttggagaattcccatataatacactttgttcaaaaactccagtaccttcattagcatatactttaagagaattaggttatacatctaattcacttcataatcatgatgggaaattttattctaggaataaagcttatgaaaacttaggttttgatgcttttacacctattgaatcaatgccagttccagaaaaaacaccatttggatgggcaaaagacaatgtattaattgatcaaatctgtgatatattaactacaacagattctcctgatctagtattcgggatatctgttcaaggacacggaacttatcctaataatcctttagaggataaagtaatttctattatagatggttttgaaagagaaaataaaaatagcttagaatattatgttaaccaaatacacgaaatggatatttttgtaaaagatttaattgaagcagtaaatagcttagatgagccttcagtaatactattttacggagaccatttcccagctttaggattttcagctgatgatatagctgaagctaatcttagggaaacaccttatttaatatgggataacatgggcttagaagtaactaataaaaacgtaaaatcttatgaattaacatcattaattatggataagatttctttcccaagtacagctttatcatcacttcataatagtgatcttgattctgaaacaaagaaagaatatcttaatcagttagaatatgacatgatatacggaagaaactatactggtgaattttcagaattaattccatctgaaagttataaaattggatttaaggatgtttctattgataatgtagaagtcatagatgactatataaacattaaaggatctaactttaatacttttagccgagtttttgttaacaataaagaagttactactaattttgtagatgaaaatactttaagtattagcaaatcagattgtgctaataattctataattaaagtatctcagttagcctctggatctgctacagtattctcttcttcagatgaatttactgtaacttattaaactactaatataaataataagctaaagaaaaaagatgatttacatattttaaattacctcctgtcaaatagacagggactgtagataattttgtgtaatatagtttcttataaatcaaatattactggaaattttgatttccagtaatatttttttattatctagaaatgctaataatgtgtttttctatttttttatagtcatttctgctttttcaagtttattacttataggattttctataaattccatccaggcatcaaatacatctttcatttcttcattctttggtagtttaggtaattctataaagtgtatttcctgaagatctgttaattcttcattgaatgaaaagggtaaatttccaagggatatatttacagagtgtggctttgatgttgatgtaattggcttaaaaagaatacagtcatcaggtagcagatggcgctccacatttcgaagaaatggtgtagaacaattacaagatactagaaaatttaatacaggaagaccaaccgaaaaagacttatttttaggggaaaaatatgaaaaactacaaacaaagttaaagcttttacaagcagagaattaacttctaaaaaagctagaaatgttagaaaggggagtgaatcaaaagaaataatagtagcagcaaataaaaagttcgaaattatgaaatccttgattgctaaatataaatttaaaaatatgattagctatctgtgtaatatttacggtgtttcacgctcgggttattataagtacttttcatctattactataaaaaagcgtgagtctaacgaagttagagatttagagagtaaagattataataattttagaggacaatgaaacttaaaaaagatgactcctgttcaatacagaaataatcttctaaattagtctactcttttttaaactgtccttgacaaggagtacaagtttatatcttgagttccttttttattataataacttttctctcttctttatatctcttccctaaataatattatagttaaattaatcatatatatctgaaaactcaatattacatctttctatatggctattttcatttgttattgttttgcttataatttcttcttcaataatctttattggtaaataaaatgtaaattgagtacctttatctatattatctaaatatatctttccaccatgcatttctacaaaatttctagctaaaaacaaccctataccactaccttcatttcttctagtcaatgaatcatctacttgagagaactttccaaaaatacgttctctattattgtaatctatcttttctccataatttttaacagatataaatactttatttaaatctacgttcatctttatttttatctcaatatctgtattataatcagaaaatttaattgcattagatattaaattaagcataattctttcaatcttatcttgatcacaagctaaaattacttcttcaatatctgtatcaaaaattatatttctttgtttttcatttgcatattgtactgtagacatagttatattttctacaatactaacaatatcataatttcctaatttcaaatcataaaaactactatttatttttgcagtatccataatattatttactaaccttaataacctatatgaattttgttttaatatatttaaatattctttatatttttcattgctaaaactaatattattaccttgattatataagtttaataattgtacagttgaaagtattatattaattggtgttctaaattcgtgagatatatttgataaaaattctattttcatagattctaatttaatattatcttctacttcacttttattttccatctgctttattataatgcttattttctttaaaatttcatttataaatgaatcatcttgattaatataatttatattttcattgtaagatattaacactaatgcaaataatttgttcgctaactgtatatgtttaattttcagattctcttttatattatttttttgtaatttttctattttgtcatatagttcagaatattttttttcatcaatttcattatcacatagtttattttctatttcttcatctatatatatttttattttaaatttactttctttttcattttcacttatataaaaattaaacatttttttatcttcatcatataaaagtatatctatattctcataattcataactttttttaattcttttaatatagactgtataattgctctatcatttttttctttacttccgtctaaataatttaacaaatttctttctaatcttaattgtatattcttatctaatgatacttcctttgccactcctcctataactttttctttagttacatcagtatttagtataaatttatgtactttatgccatatattttgtccatctacattgctatattcttcattatatatatatctattattatcaataagttctttatctgttttctcacattttttagctatatcatattcacgcaactcataatcagactttcctattattttttctttagttaaacctaatttttcagcaccatatctatttatatatatatatttcatttgttcattttttaaccatatatgataaggtaatttatccaatatttcttctaaatactctctattataatcctttattaatgtatctctttctagcatttattaaaaccactcccattaattctatataatacaatatataatatattatatattgtattatttttaaacattaattccatattttatatttataatataaaacttatactaataggtattattttgaaaatatataataagatccaatagaaaattcatattctagtattttcataaataaattttctttgtttattagtaaatgatttttttccacttattaagttggaagtaactattactttatctgttattttagaaaccattgatggtgagattgttattccatataaatcttctatctcagcctgaatatcgctagtagtcataccttttgcataaagagagattatttttttatctctgaattgtaatcaaaattgatatcattttttcttcccatagaaaatcctcctaaaatctatatagtatattattccaaacataccaactaatcataaaaaaagagtagatagatttattttttacataaatctatctactctcccaatagacaggagctaattcatctataaataatcttttttctttaaatactttagctatttttaataatctattttattaaaatttaacatttatacttctcttattagttatatcccttaggattattgctttgccatctccaagagtcttcgcacatttccttaattcctctttcagctttccatcctaattcttcattagccttcttaggatctgcataacaagtagctatatctcccgctcttctttctactatttcataaggaatttctcttcctgatgcttcactaaatgccttaacaacatctagcactgaatatccaataccagttcctaaattataagttacaagccctggattagttgcaagtttttctaaagctttaacgtgtcctacagctaaatctacaacatggatataatctcttacacctgttccatcatgagttggatagtcattaccaaatactcttaattgttttaattcaccaattgctacctttgtgatatatggcattaagttatttggaattccatttggatcttctcctattattccactcttatgagctccaactggattgaagtatcttagtattgctatgtttaattctgtctctacctttgcaatatctcttagcatatcttcaatcataagcttagttgctccataaggattagtagttgataaaggagaatcttctgttataggaactacctttgcatctccataaactgttgcagatgaactaaatacaaagtttctgcatccatatttcttcatagcttttaatactactaatgcacttgttaagttattgtagtaatattctaatggtttttcaactgattcacctactgctttaaaggctgcaaaatgaattactgaatctatatcattttcttcaaatattctttctgtttcatttacatctgttaagttaacgttataaaatttaacgtccttacctgttatttctctaattctatctttaacaagttccttactgttacttaaatcgtcggcaattacaacatcataccctgtatttaaaagttctactgttgtatgacttccgatataacccattccacctgatactaatactgccataattaatttcctcccaactaattattaatttcctcacttattattatataacatatttttcaaatattaaataacttttttaaattaattaataaagttttctaattacttttccttatataataataccatatttttcttaaataaatttatacattttatacgaatatcttccctgtaatttacccaatataacttgagcatttatctaatcagttgaatattttcccataaaagagcaaatattaatattttctgtcaaattgcatttattcatgttaaaattattacgttattaaaaattacaagttttatgattataggggtgagcttatgaaagggaaattatctacaacaaaaaaagtactaataggtatttgcttagtattagttttaatagttggaagtgcagtatttgcaattaatcactatgcatctaaagttgaaagggttaaaatcgatagatctaccgtaactgaaactggtaaagaaccagcaaaagaagatcaagatcttataacgattgctttattaggaacagattttagccaaaatgaactatatggtaatcattatggggctgcagactgtactatgatattaggaatagataaaaagaatgatagacttaaacttttctcactaatgagagacatgtatttagatttacctgatggaagtggaaaacaaaacttaaattacacaatggcatatggtggaccagaggttatattaaaaactataaatacaaactttaatttaactgttgataagtttatttctgttagtttacacactttacctcaaattatagataagcttggtggagttgaacttacaataactaatgatgaattaaattatataaatggatatatttctaatattgataaggaaaatggtacaagcactgaaagattaacatcagctggtactcatactttaaatggaactcaagcggctgcatattgtagaataagatatactgaaggtagtgactataagagaagtgaaagacaaagagatgttcttgatgctttatttaacaaatttaaaggttcatcaattacagaattaatttctataatggatgatattttacctttagtaacaactaatcttactaatagtgaaattatctctattgctagtacagtattaggcatgggtatacctgaaatagaacaatctagattccctcttgatgggaaatctgaaactatttatacagatatgttacatttaactatagatactgaagaaactactaatgacatacataaattcttgtattctttagagtaatttaaaattatacctaaacaaaaaagaaagtattaatttaacactttcttttttgttttatatttatgtgaataacaagtgttaaaaacctataagtttatgtttttaacacttgtttcttataatatctaagctgattacttacctaaaagcctatactttatttatcgccccccttcatgcttctctttaaataacttactacttaccaccgataaaagcacacataacaataaaaccaaataaataatacttaatactctatgcctattctttttactaatcgtatcggctttattagatgaaatatcacttcctgaattactctctgtagtattactagtatcacttgcttcggctttctctatatttgaatcctctttattattttcattatttatactgtttttatttgtatcattttcttctgaagctgataaatcttcattgttatttgttatgctattatctaaataatttaataaattatcatactcctcatctgtaaacggtgattttttataattatcataatatttctttgcatcttcaatattacattttaataatacatcatcatcttccttatccttaatctctaattccttattatctgaatcaatcctaacttcgatatctaaatcattagcaactcttaatgcttcactatatattccaacaagctctgataaagaaaaatcacttattttctgcccctctttaatccttgaaaacacttcactgctattattcactattgcttgaatttcttcagtgctaatatctaagttttctatgtgctcgctaatattttttgaatactcttctggaattcctacctcttcaagcttttccttaaaaaagtcaatattttcactatgtactggcaatataaatgtatttattaataaaaaactaatcacaaccattttggttactattttaatcactcttttcatagttttagctcctttttataaattcatttattttgattattgccataaatcacaaaaataaactttagcttataaatgaaaatagttagaccaaaaaggtctaactattcccatttatagtgaaaaaagatactatcacttatattcatttttttagacatttcttttgcttcatttacagattgatgagccttaatattactgtaattaatatcagcattgaactcagattttcgctctaataactccatgcctatactatttttaggttgcttatttaaaaattatatttataagtcttgattctaaagagctattttttcctcagaggcggtatatattactattatttatcatagtaaataaatttaggacacctctgagactaatattgtgcacttataatattatttccttactgttaaatctcttttaagtaattgtaaaattatgtttaatttatgttaactttattaattatttatatatttgataacacctttgtttgaatcatattgcttaattgagatatactttattaattatttatatatttggtaacccatttttcatggtttaaattttctaatttataattatttaatttaatatatttaagtagtaaaagctaggctttatctaactttcattctttatttctttataagaatatggttttctcataaataagaaataaccttataatccaaaattccggattacaaggttatttaacaactatatttgcgatacatttttacttgtagcatttttccttcaataccactgactcaataaaattaatattaaatctttaattaataattacataaactatccattattaaagtctaggtatatttatagtgaattcagtaaaatcatcatcacttgatacacctacagtcccattagcactctcaataatttcttttacaattgaaagtccaaatccattttctcttttactattttcttttgttgagaacccaacatcaaatatcttatctattatatcttctctaatctttggtccattattttttatttttataataacatcattcatactataatatgacttaatttgtattactccattttgattcattacattaacagcatttcttaatatgttagaaattactctttgaaactctacttctgaaatacaaatatcttcaaaatcaatttgatcatctaatataatatttattcccttatgttctattccattaataatagcttccataacggaatcagaaccatttattatttcaatttctgatgctacattactattgttattgattatgccttttaaaacagaccctaacctttcatattgtcccattaagtataatccatataaatatgatatctgtgctccataatcatgtttaactttttttaattcgttattcatttcttctaaagcaaggttgacattcaatatttcctttgatttcttttctatattaaagaaatataaagtaagtaaaacaataaaaatagaaaaacttataaatataaattctttaaataatggattgtctctgtcatgtactattgcattaaatgatactaaaaaatccataactatagttacaatgactattgctactattgatatgttcctacttcttattaccttataaattttctttataaactttttattacataatattaaaatagccattatgtactgtggtaaatacataaatattatcatgcctaattcaagatacttatctaaaaatatatattgtaaatatcctaaataaatattagaacagattattaaatttatagctatagatatatatactatcccaaaccctatcattgatcctaatgggtcatttttaaatattattattattgaagttaacattacaaaatgaataaatattgttcctaaacttgaatttcctacaagtccagttgtaatttcaatcatagcccataaaattactaccattgctattaaatcttttgaatttttttgatatatttttttagtgcaataatttgaaatataaattaaagctatactttgtaataaactactaattgagtctgctatattgataatcacgtctgtcaaaaccttccttaactttttatggaatatgggcatttccttctgtcaaaacctatcttaatttttttatagaatctggcatttcttccacacctatagttaatactgatgctgctcctgagcctactaataatgtagatataaataataaacaacttgctaccattcttttcatttaaagtggaccctatgtcaaggacattaaaaaaaaggggctaagccactaaaagctgatttctgtattttacaggagtcagctcttgataaatacaaactccattccaatttaaacaatcacaaaaatgactaccttgtaattgagaacaaagtatgcattcaccactttcagctaaatggcaaggacaagcttggtatatcaaaacgcgactttatgggatactttactaatgaatgttaatattcacaaatcttttgtattaaatacggatgatagcataagttctaagttaaaatactataggaaaataaatggattaagtagaaggcaattagagattcaggctaatataccaataaatagtataaaaaatatgaagataaaaatatttatcctactaaagaagtttcaaagaaattagcagccttttttgaactggatacaaaatatttttatgattcaatgtatgaagaggatgtagatatttctacaactttaaatacattcatgaatgctaataatctttccattaaatctttagtaaaattaattaatatatcacaagaaacagtatctaactggttatctaataatcaacctatatctagaaaatcatataacaaattaaaagaactaggtgtattatcctagttctttccttcagatttgcttgttattcttctatttttacaatacagtcttttctataaaaagccattccatactttataatatcctcataaccactttcattaagctcatatgcatattttttatcttcaatttgctgcagagcatcttgtggctttgtaaatagctcttttggtttatcacaaaccttcatttcaattattactgctttatcaaaaattgatagtggctttatataaatatcacaccttccatcaccggtctccctatttgattttacaatgtaaccatccatatgcgataataatcctatcataaatccatgataaaagttttcatatgcatcattaaagcttattgtcttcttcaataatctatttacttccttttggaatacatcaacttctccttttataattgaagtataaagaagagataaatcttcgctctttatcttttcattaaaccatttaagtatcttagttctaaagatatacttaacttctaagtttggtattgctaactctacaaacttttcttgggtattttcatccattctttcacttatctttttgaaatatcctgtaaagaacataaagttccaaaggttatctaaattatcataaacatcatcgtaggttatgtcttcatgtactggtttttctatagttttaccttctattaaagcctctatttcgccttttgttatatcatctgctctttctataagactttttactatactgtttgagcttgtatttgcccaatatgatttaggtaacttatttatattagcctttaagtcatcaacatattgcattacactccatggattatatacatttgtttctccaaatatatacccattgaaccactgctttatagtttcatacttatgttgcatattataatcatcacaaatttttacaacctcttcatctgtaaacccaaaatgctctgcatatctatcatctaagatcgatataattttcaagttgttaagtcctgtgaaaatactttcttttgagatacgtaaacaacctgtaattactgaaaactctaatgatggatttgtttttaatgctgactcaaatagtgatcttataaagcttatcatttcattataaaacccttcaaaaaaagcattttctagtggtacatcatattcatctattagaattattactttttcattgtggtatttactcaagcaattacttaggaattttaatgatgtaatatataatgacatatccttatcattatttacaattttcataaaatgttctttttcagattttaatacatcactttctattatatattcatgtcttttgaattcatttgaaatttcttccctgatgcattgaaatgctaaatctaaacttccttgctttgctgatttaagagaaagattaattacaggatacttaccaatatccttagtatatttttctcctgatacctttatatttaacccatcaaaaagataagagttatctatcttctctccggtaaattcatctcttctatcttcaaaataatattgaagcatactcatatttaatgtcttaccaaatcttcttggtctagtaaataaatttactgcagctttattatctaataaatcctttattagaagagttttatctacaaagtaatatcctcttgttattagcatttcaaaattatctattcctattggaagtggtttttgctccatttcgccttacctccactttctttcttaccttttattatagcctaatttttatgttgattaaacaataagtttaaattatttaaactgttcctcaaagttaattttatagatattttatctttttattctctagaaacaaaatggtttacgcaccttaatacataaaccatttaataaaatatattgataccctagtgcctgacactggtgattccctaaccccttggtgtatttgtggataattcaaaatagtgacaagcttatgatcatgcatatgcttaccaatgaaattatggaattttaaacgtatttccgaaggaagaagcttatttcttaactgaggttatcacctatattgttatattactcctattgttagcttctataattcttgattgtaagttttttagcatgttatcagcactttcttaaccttctaagagtgaacctgtttcttgtctgaatcctcatttaggattacctttaaatgctaaccaattaaatctagttattacggtaaatttattatcacaaaccaatactttttcatgagtattgcccaattttataagttataatatttccctatacttttatcctctttaagcttatttaataaatctactgcatacttaacatcattatctattttatcaccaataccataacatataactaccttaacccttctagtcattgcatttttaatttcgccccttaattcaaaatctgttgcatcccccttaatccaaggagatactatcacaatttgactctcagtctctcttaatgctttaattactattggtctatgttcataagtattaagtatcttaggtatcatagtgattttttgcttttctaactctaattctttcttcaattcacttatttgcatagtctttgaaatatattcttcatctgtttcaacatctacactctcaatatcaaacatataattttgaaaaaattatttccacatatattaaaattaatattattgttcattctttgcgtaaaatcataatctttctcaattttaaatggcataaacttttatcattaaatggcaaattagaattatgcatataaaaacagaagataaggcacaatgatatataaatgatatatattggctttatcttctgttttttcgttaattgataatttaaacttcttaaaagtaaatgtctatttctttttatttacaaaaatagcaaccactaatatagaaataaaagtaaatcctgccatcatccacatttcagtttgaaaattattagtagttgagacaataagtgctaatccaataggaccaccaatttggtgcatcgtatttgtcaccccactggcaattccagccagttcatctggtgcttcatgaactccagctgaagtgaccggtgctaaaatcaatccttgtcctaacccaagtatgataataggaataaaaatagtctgccaataaccgttagctggattcgaaacagcaagtatgattaatcctattgctaagattatttctccagtaagtaatagcttgttgttatcaaattttttagttaatctcggtaactgcatagcaataataaaattaacaattgtcattggtaaaaaagcaactcccgattctaaaggcgaaaaaccatattggttttgcatcatttgcggtaaaaagaaccaaaatggtagcatagacatcataaataagagacgagcgacgtaagccccggaacgtatcttatttttaaatagtgataaaggtaaaataggagaagaagccttctgctcccagaaaataaatagacctaaaaagatgatgccaataaatacgaatttaaactttccttcagtaaatccatatatgattcctatcaatcctataatcgataacaaactgcccaaataatcaacattttcttttcggcgttccgtattattcacatatttcagtgttaagacaaacaacaaaatagtaaatgggacatttattaagaatcctgcctgccaagaaattaagctagtcagtccacctccaactagtaatccaatacttgagccaattccagcagttgctccgtaataagaaatagcacgttgtttcatgttatcttgatatgtatccataattaatgcaagtgttgttggtgcaataatggagctaccaatcccttgaactgcacgcatagcgatcaccatttccggtgttttcgatatcccaatcaccaatgaacttattccaaaaataaccagtccaatcaaaaaaatacgttttcttcccaataaatcagaaagtctaccgcttaaaagtaaaaaccctccaaaagtgagtgtataagcacttgatatccatgaaagtgccgtggcagataaacctaagctttcacctatctgtactgaacttgtaaaaataatcgaattatccattaatatcaaaaaatacgctagtaatgtaattggtaaaattattccaaatttttctttcttcaacttttctaacctctttctttttctttagttgtttaatattttttaatcaagtagctatttcctttgacaccttctctttagttatatctttaattacaaacataaaactgtgtatttcttatcccctttttttttttataatatatccttttagcacattttctattctataatcttctggtcttgattcttttgtttctatttgtactagatctctaacaacatatttgtactgtctactatcattctccaaatctaataccatcccttagctcggtcaatacaaccatttcataatagtgtctatttatagatacatccttctaaaaaacattataaagtaatttgatacaaattaattttcaaccttgatttaatattttagaaactccttctaatgctgtatgagtacatcccttactattcggactaccatttatcaataatactttcatttactttattcctatctaataaggcttgctaacatctctactgatgacgcttcttgatggttaaagaaagaactttcttttttatctaaatcagaaattttatccatatcatcctttgttaattcaaaatcgaaaatatctatattttgcaacattctttctttattcactgtctttgatagcggaacaattcctctttgtagcaaccatcttaaaataacttgtgcaattgatttatcatacttatctccaattgcctttaaaatagtattatcaaatattccatttcttccttctgcaaaaggagcccatgcttgtagctgtaccccatacttactattataatcctgtgccaatatttgttgattaaatggattaatctcaatttggtttactgctggtgttacttcattaaataaagctaagtcaactaaacggtctggatagaaatttgacacacctatcgccttaatttttccctctttatataactcttccatagctctataagttccataataatcatttaatggttgatggattaataccaaatctaaataatctaacttcattttcttcaaagaagattcaatagatttttttgctttatcatatccaccattgctaatccatactttagttgtaacaaacaattcttctctaggcactgatgatttagaaatagcatctccaactgcttcttcatttccataagattgtgctgtatcaattaatcgatatccagcattgatagcatctagtacaaccttaatacattcttctttatcagtaatttgaaaaactccaaatccaactgctggcatatttactccattatttaaggtaacatattccatttaaactcctcctttatttttagtattttatattttataataatattactagccggtagtcactaccgagcaagactttttttaaaattaggaggcgatttcatgtatacaagcaaatatgtatgcgaacaagttggaatatcttatgaaacattaaagttttattgcaaagaaggtttagttccaaacgtaaaaagagataaaaataactatcgtatttttgatgataaaaatatcgcatggttaaaaggtttgcaatgtttgagaaaatgcggtatgagtattaaagatatgaaattatatatgaatcattgtatagaaggtccatctacaattcctcaaagaaaagaaatgcttaataaatcaagagaatctttattgaaaaaaatcaatgaacttaatgaatatattgactttattgataataaacaagctttctacaatgatgtattaaatggaaaaacaaaatatataagcaatttaattgatatagaaaatacctaaatttaataaagatattttaattaaattattattagtaagagatttttcactctaagaaacttctactgttaagtgttaaaagcattcttaatttacttcatcttatgtcaatatattttatacaaaaagccaacctttttttatgctacacttttagctaatactttttcatttatgttaacttgtctaactaagttaatagtgtagccttttatgttataacaattccttatcttagcatcagctcatacttcttaaattcatcctttaacaaattctttattatgttaatacttattggttaaggctaattcgcctggttatcatttgttactttctaattctttttgctttagaagttctaataatactccacacttttcagttcctaattctttcatcaaggtaatggctaattgtctgttaaataattcaatgttgtaatctgatatctcgccttttattttaactttaatttcccttgccattccctcacctcccatttaattcttgttataaacagaattcttagctctagtgggggtactcccattggaggttagaattcgttatccagggacgtagcagccgtttactcactgttatagaacaagtgagtattacggatggtagccatcggatgaaacttctaacattatattcatctgttctaatttctgacactattccaaaactacagcctgactaatgatccttttgcattatgtaaaaaatttggtatatgattttacatagttccacttggaaatgttgaaggacattacacctacataaaaagaaagaaagtgctttttataaatgaaaactatgcctatattcgtgagccttagagcaccaaccctaaaaaatgaaattaacaagttttaaacgccccaaagtttagtttaaattaaaaacatttccctagtagttttactactagggaaagttatttttacatacaatattaacagatgaggtgattataattgaaaaaagcagcaatttattctagaaaatcactttttactggtaaaggtgagtctatagaaaatcaaatagaattatgccgaagctatttagagagatattatcctgaagtaacagacttctcaatttatgaggatgaaggttttactggtggtaatactaatagacctaaatttcaacaattactaaaagatataaaatcaaatagtattgatgtattaatatgttatagattagatagaattagtagatctgtagctgactttgctactacctacaatatgcttgaagaacacaatgtagcctttgtatcattaaaagagcaatttgatacatctacacctatgggtaaggccatgttatacatatcatcagtttttgctcaattagagcgtgaaactatagctgaacgtgtaagagataatatgttattgttatcaaaaactggccgttggttaggtggtcaagaaccttttggatttacatcagaaaaggtatcttatattgatgaaaactacaatgaaagaagtttaatgaaactatctcctattgaagaagagttaaatatcgtcaaattaatatatacaaagtacaatgaaactaattctataacacaagttactaattacttacaagataatatgtataaagggaaaaatggtggtgaatggcagactatgcaagtaagacgtattctctcctctcctttatatgttaagtcttcagaaataactcatgaatatctaaggagtttaggactaaatgtttatggtgaagctaacggtaatggctacttaacttataataaaacaaaaaaaatgactatagatagagatattaaagaatggatatatgctgtagctaatcataaagggattatagatagtacagaatggatacttatacaaaagttgcttaacaagaataggaataagaaggttaaaagattaggaactggtgctaataacagtgcattattaacaggcatattaaagtgtagtagttgtggtgctaatatgataataaaacagggccatacatcaaaaacagcccctggagttagatatgactattatgtatgtggttctaaagataattctcgtggaaaaaaatgtactaataaaaatataagagttgatagattagataagatagttacggaccaactatttgcttataatagagataccttaaataaatatttactggatttatacagtgatgcaactaaattagatattaaaaataataaagttgattctattagatctgatattaaggaaaaagaagcagcaataaatacacttattaaacaattatcacaagctactaatgaaacagtttctaattatataatgcaagaagttaataaattaagtgatgaagttaatattctaaaggaatctttagaaactgaatccgaagaaaagaaaactgttgcttatgacatagaaaacttaaagatagtattagatcaatttgataagctcgaatctacatttgaattaactgaagatattaatacaagaagattacttttgcaaacaattttaaccaaggttacctgggatggtgaaaattatgaagcagagctcactattcttgaggataaaaaaataattcccagattggattcttttaccaaaagtcactctttagaaacccaaggtcaagcttggtataccaaaacgcgacttttgggaatactttgctaatcaatgttaatattcacgaatctactatattaagtatagataatagcataagttctaagttaaaatactatagaaaaataaatgaattaaaatgatatttttctaaaaaacaaaagctctaagcatcaaatgccttagagcttttacatatctaaaagatattaaaacttgaaatcaattcatggacatcttcaataaaaaccttatgttttatcctttactatatcaattatttctccacaaataaccctttctcattttctatcaaatcttctactaaatatttataatccaaatactgtattccattttctccattatgaatttgtttgcataataaacttttgtagtatatgtccatagcaacaattagctctatgtgttttttatcagctaagtattttataatatcattatcaagtgattgaatgtagaatttttctagttcctcttgattagttaccatttacttcacctcatagctttctaaaaactttaattcattatcaattaaattttgactaattatacaaatttgattattcattttataatatcgtatttcctttaaagttcttttttcatcccatagacctttaaaatacatatcaatacttttaaatacatcatcatctgctacactaccactaattaaatcatattgtttgtatatatcatttcctcttcgacattcacaaacaaaatttaaccatttctcatcatcattaaagttcacacatttatatttatctaattcatcttctaattcatatacattaactatagcactttttctatttctcatcgaacgtcttgtagcccatttttcagcctgttctttatacgtagtaacataaaaccctctaccaaaatctaaataattcttagaaaattttatatctggattttctattacttcagtccccccatgataaactatcataaattaatacctctttctctaattacatccgttatatcttccattagatattcacttcctagtgtatggagaacatcataacattctataatataatcttctaaaatattagaatcttttaatattttataaatatcgctcactggcttttttaagtaatcagagagtttatttataatgaatactgaaaactctaactcttttttattacaacttttcatttaatcaccacaccttatataattaagaattatttaaattctaaccaaattctctactgttaaactacacttattctcatatttcagctgaaaatcaagcaaataaatctttgtactaatactattattagatgttctatattttaacaccatatttcattacgctagtattaaccaataactcacatattcttctagaataaaaaacactactatataccaatttcatatggttctaattatatatttaacttttaattaaacaaccttctttatatattatatatcttttttctaaaacttccaacatatcagaagaaacagtatctaactgattatctaataagcaacctatatcaagacaatcatacaaccaattaaaagaactaggtgtgttgccatagtatattctttttattctcttaaacaacaacaaaagtcttacgtaccctaatacataaacccttatctacgttattcttactttatacttagtctttcatttttctctttatgaccgtattcatttctgttctagtaactattacttatccctagaaattcatggtcaccctggttaattcattaactactagccttgctttgtcaaaggagtatggatataaaagtacttgccctgaggttatacttgttgtagctggcgatatgctttaacttctactaatgtacaaggctcccccatgcatgatctattaataattcagcattttttccaaaaagcttgcataataacttttcaccataaggtaataaagacattcttgcaatatctcccatagtgtacataccgtttgcttctagttttttttgcataccccttgcctactctccaaaacgatgttaaaggtttatgattccacaataactgtctataagacatttcatcaagttctgcaatacgcacaccctctttgtcagcaggcatctttttagcaacaatatccatagcaattttagcaagatataaattactccctataccagctgttgcagttataccagttgtctttaacacatcatgaataattgtcatagctaaatcatgaggagacattttataggtttttaaatatgctattacatcaataaacacttcatctatagagtaaatatgtatatcttcagatgctatatattttaaataaaccttataaattctagttctatattcaacataaagagccatctggggtacagcaacaatataatcaacagataatgctaaatcatctatactataagaagcacctgtaactgccttttaggtacataaaattaactacattacctgaaacatgaatattattatatagcaaatttattatgttaatggctatattaacttcaacttcgggattcttattatttaataaaaagaaaaaaatttaattaataatgcctggatatctaatcaatataagaatagacatccaggctattatttctttatcaaaatcattttttatatttctaactatgatatctttatatattactaaaaattcattttatgacttatagataatcgtcttgggaaataatcacttcttcaggtgataagcaaactgcaatcccttcatctaaatcatcattatcatcacaaagcaacgcatatgaaccatctctatttatcaaaagtgtttttggtacatattgtgtttctgcacaattagaataatcctttaataacttttcagctatctcaattttactttcttttgacctatcatactcaatatatgcattctcttgttccttggtaattccatcctcttcaaaataagcctgaagttttaaatcaatattatattcattaccaaacaatttaatggtcttttttgctttccagcctacactaaatgtaatctctccaaatacataatgtaacatatattatgctcctttcttagcttctgaaattccaccgctatgagacatgttattatgtacaatgctaggtaccttttgcattgttttcatatccttgcactcatgccatgtgtaactattttcttttctccatttcttaatttcctgtggtgaacaccctcgttgttttgcaagccctatgtctgccttatcaaaattatctgctctattatcagagaaatccttaatctcaacatttcctttactaataggtctaaaatctggttctccatctttatattttataccatctattccatgctctttcaatatttgcccccatgtttttccttctggatttgcctttttaggaacatactctttatcaggacaccattttgaattaccacgttcatcattccactcaccattttcaattggacaacacttatatacgtcatacataacagccaatgatttatccgccataatagcaagcctatcccaattaaatgttcctagctttttacctaatgaagaatcagcaaatttactacattgcacttctttaacatcattatggtttcctatcatactttagatctcctttctaacacagactgaatccaatttaaatagattttctctcttatttcagtttcctcctgttgtgtactcatatccttcataaaacattgacttaatgcaattataaggtgctctgaaggattatcaaataactgttttactattctgccaagcatatcagtaagttcattgttatctattgctgtaacaacactattttcaattcttgcacgcacgcctaatatatcagttatccttctagaaagttttctaaaattctcttccttccaaataattaattctttattctccttaaactctaaaatttgttcttcaacaaattcataatttaaagaagataatcccaatgtatcaagacctttttcaatctgattaattgaaaattctaatctctcatttactcttccttgaattaaaaaattaacaagttgagagcgaatattttctgaatcatttttcattacttcaccagtaaaatcataaactctttctgaaacactacatttgttaacttgaactaaaacaggttcaacccagtcattttggtatatagctgcaactcctcttttcaattttgataactctttgatttgttcctcatcaagtccagctgcatatcctactaattctcgatcgctcttatctggcaaccttaaaataatcttagtattagtatttctaataacagacatatctaataaacctggtgactggtctgctattatgaacccttctccgtatgttctcatttctgcaattgaatttgctagtagttcaacagactttcctaatagatttgttccttctgaggattgttctgttgaagttcttttaagaagattatgtgcttcttctaatactgtaatatgagataatgggctgtttattcttcctgatgacattcgatattcattaagcttcattactaataaccccataattagtgactttgtttcagtcgaaccaacacgacttaaatcaacaattacgtttttatcaaataaatcttggtcacttaaatcatcattacagaatattaaaccatttaatccatttgtaagagaacgaacacgagttaataaagctcctgaataatcccctttactatctgatgaatatttagattcattaataacattctcaatttgctcaagcaaatcagcaaaattaggatatttatttcctttatgattttcagatgtacctaaattccatcctgcagttacatatgccttttccattgactcctttaaaatcgctggcattgcggcatacattggccaacatacattaaaaatctcaactaatctatctaaatgttctaatacatgaacatcttctgggaatctaaacggattaatcctaagcagagtagattttttaggatttgttccatacacagttacatcagcaaactgtccaaatacatttttatattcacctttagccggttccactacaagaaatggaatatcatatacatttcttaactgatttaaaatttcatatattgtattacttttacctgaacctgtagatcctgtaacaaaagtatgcatagttaatgaattactatctatattcacttctgtttcagtttctttccccatactgaatactttgccaaggcaaaagtccttactgtgtagcttagaattatattgtataacttcttttccaaaatccgcatgttcaataacaggaaaaccacatacagattttcttggcaatcccatctgaatggctaattcattactactaactaaagaagcagctgttactggaactgatacaatttcagatggatatctgaaaacaggatgtataaaattagttatatattcacgtaatactggcaattgtttttgattttgtctgctccagaaattaatcgaagatgtctctatccctgatttttctcccttcataagtgctttatatgttcctgcagccatttctgctgtttcctgactatcagaaaggaagtatgctgcacattcccatattcctatgctttcacactcatcaattctcttaagttgtaaatctattctttctaatatatttattaatgatttattctgaagtgtcagttgcatattgtcagaagctcctgttgtaattccctttgtactagtttcattttctgttgtgctttcatttgtagcatctgtttctccacgagtctcagaattattttcagaatggctttcatttgttccttttcctgtagtagttgacttaggattaaaagtattaagagccatttgtccaagagccattccacctgcaactgcaatactagcaccaccagtcattggtgcagtaactaaactagcaacacctagtgctgctactcctaaacttttagctaaagctcctactgtatctgtttttgttgtagaactattttcagaggtcccttttgagtaactttttcctgtttgtactgatgtatttacagaatgagaagaacccattgttgttccccttgagaatgcatctgacacactcaaagctgtattagttccgtaagatacttgcatgtttgtaaatggagatagtttagtataaatgatttcataatattgacgcgtttcttcaagctgatccataggaacactcttagctagtacgatagctgtatactcctgcccctgcatagctaaagccattttttctaatccttggatgaaagtttcgttatccttgaactcttcatccttatttttagcaatacaagaaacgcttgcaatatttttactagcaatattatccaaaaatttctcagcgaccggatccatcaaatcttcagtctttacacctggaaattgaccagttaacgcattttttaatgtgtcctttagtgatttcgttgtacgcctatcatctaatgagcgtacacccatataaaaatctgtcttttgcccattactatcaacaacaataaatactccacaattcaggttttgtaaagcattaaaaacagatgcgaatttatatgttgaatattcattattttgatataccatctcagtaatcttaaaaagacgaatatcacttattttctttaggctatcatctaaaggtattatttctaaatcagtaagtttatgcaaatatttttttaaaacaatatcatcaactagcttactagcttcagtaaatcctatttgaagtgattcataattaggtacattacttttggttttttctgccataactgtatctttaatatcttttgatatcgaaatactattttcatgacccaatataactgtgtcgctcatctaattacctccctttgctacaacagctactacaacaccacctactactgcacctaatgctgcacctactaacgctcctccaacaactgaaacactagcagttgacgcaacaattccacctacaactgcaccagcaactgcaccagtaactgcaccagtagcaacttttgcacgcaaatatcgaccatcacgttggtcttggcttttcttctcttcataactcatatgagtactctttatagaatagtttgtccttgtattactaatttgctgtgttgttcctgctacagcacatacaggacgtaaatgacgaaccacatctttaacatgagaaatacgctcatgggaaaaattacttattaatttaaccatttgtttatccatatagttatcatcccaattgtcttgattttcttcaaaacctctaccatcatgagcatcatataatccttgcattgaagctgctaccttttccatttctttaaattctgtaaaagatggatctactaaaaaactgttcttcatcataatgcgaacacgtcgtacatttcctgaattaacagcttcataaaaagcttttgttaatgccattttcagcacctcccttaaatttcgagtatagactcaactttagccttaattatttcaagccatgccaacttgcgctctgattctttgatacgctcttcagcattttctttatctgtcgcaaaactttcaagttctgaaagcttttgttttagaatatcatccaaacgcttaaattctttatcaaattcctttacaattttgttacactgcttcattgcataggaattagcttcatctccattatcgtatactgtttcatcaataggagtaagaaattcctgagcaagctctgatgcatccacatatttaacagttttgtacttagttgtataataacccttctctttaaaccaagtccaaggtttataccatttcttatcataattctcaacccactcttctccgtcttcaacttctttagactgaactagtcttttcacagagaaatcatcagctgtcataatagtacctcccataaagctcaaaggatcaatgttaattgctgaaagtccttcagactcaatatcttctcttaaagaagcaagtttctttttatattcttctaaaagtgcattacttgtcttaataagattatctctaataagctcatccaattctgttttgaaatgagattcaagttctttagcaaacctttcaagtcttataacctcatcgttgacttcgtctatatccacttcttgtccacgaacctcatctatacgatttcttattcgttcctgatatttttgaacaatattatcaataacttctttagcttcatcattaacactaataacagcatcctctactgcacctttaaatttcttagcagatttaacatcatctatattttttctaatattagtgatatgtgctactatacgttcactttcatctctattttttgcaagttctcgtttagtttcttcaaaacatccaactgcatcaagcttatgcataaaagtatcaacaatatttttaattttagctgtctttgcatatttctgtacatattgacgaattgcagcttctacagaaataacccctgtatgaatcagtgcctctgcatacgcatcctcaacatttttagcttctgaaagctgtctgttaatatcaccacgaatacttgatggaagtgatgcataattttcaaaatgaaaagctttatttctattaagcttacgcactttcatctctgtttcatctaatgtatcttcatcaacctcagctccactagaaatcaaacgtatattaagagccggaagtgctgcagcagggaaaatattaggtttgttaattccattcttttttaagtaagcacgaatacgttctagtgtctgttctgtatctccatcttccttcctacgatcatccattttattaacaacgaagataaatctgtctttcgattgttttccacctaccttcatgctatcagcaacacgctgcaataaggcattatcatcatcagaaccaaaggtaccttccattatatataaaactaatgattttgaagatttacttaaaaactcgctttgtactttcttgtgttccgggtccctagagttgttagggcctggagtatcaatcaaaacaagtgatacatcttctgtagatacaaaaggaatattcccattaactttaataacagatacgtcttcatctccattcaaacgttccattgtagaatacgttaattcctcataagactcagtcatcttattattcttgttatatacttttgctttccatgaagtagtacaatcgttactatcttttattttagtaattattgctgtacacgcttcctgttttgaaggcataagctttgttctaagcatagaatttataagggtagatttccctgcactcattgttgccacaacacatacttcaaaattgctactctttgcatgttgaaatgcgcttaaaatctcactatcccttaattcatcaaatggaccattctgaatttccttaaatacctcatcgataagcacttccttatctgaggtttcctttgcaggttttctatcaagcttagctgtcaattcgcctctttcatatgctaacgtaaagacttctgttaaatcttcgaaatcaagaagcgttccatgaaaagttatattaaaatctgtatcattatattcatcaataagaatacgtggtaattcttccacccattcttgaagccttgaaccaggtgtaattttttctcctagcttgctattatatgctagctttttttcatcaacagttacttcagtttctaatttatagggattgtacttaataaatacttttttcatatatctcctccaaataatattttttctaaaccatataatccacattttttactcatttcaacaatttcattgtcacaagcttcctcataaataccctcgtaatatttagaaagatcatatgacgtttttctaaattttttaatatagagtaaatactcatccatttcatcctctgtaaattcatttccatttgccttcatcttaattagtaatgcaaaatatgcggatatgggacaaataacaggattttcaaatcctatcaagataagatccctttttacaccttcaatacttgctaatatgttatcatccacaattttaaaatcatcaagcttatttaaaacgaatataaccttgtccttcggtacattgtctgatatccattttaaatgagcaatctcctcatctgtacctaacttgtttgcatttagaacatatattactttttcatactgctcacattttaatatttctcgtgatattcttccatgatttcgatttattgccgagttcacacctggtgtatcaataacacaaagacgtctatctatatcatcaatacctctaaaataagatgcaatgcttgtctgaaattcccatgaaatactttctaaatcctttggagttgcattattagtaaactcagaattttgcaaatgaattctaccatcttcatagggcttattatataaataacatatattacttgtacaaacttcttgagaagttttagccaaagactttccaaccaatgcgttgatcagtgttgatttaccagcactcatattggcagttactatatacttatgcatctgactttttgaaaagcttctattttttctgtattgcttaatcatttcttcagcaaatataataggttcaatatctacattagtatccttaaaagcatttaacaatacttcaaactgttcttgctgacgtttagacatatatgttttcatttccatagcagtttttctaatcaattcatcatccataaaaatcaaagcagcatcacataatatccagtatctatatttatttctccaaggttgaaatttactattaataatactctgaactatatctttaatttcaactttcttccctgtaatttctgttccactcaaaaatttttctctatactgcacaaggcgagaagccgtatatttattatcaagttgtttttttacaaaatattctagtgttaaataatactgttttttcaattttatctttacatttctcataggatgattactcaaatctatggatgttgtaaaccatactattttatcaatcataacttcttctttatctaccctcacttttctagctctaataacttcatcatatatttatatcttctaaataataggtaattatttcttattattttattgtatacattattagatctccttgatacataaactgaattctctttctaacttctccttcttcaaatctatctgcataaggaatataaaattttctatctgcagcactatatttaataattctatctattctaaatacagtaggattattaaatttaaagctatcaaaataggcaataggataaaaataatactctgaaaatactattgatactggctttacatttctttttacaattttccatctgccttaatataaataatttcaattacattttatttccaatagttcactggtattccatttttttcaaaatggctttattatgcttaagaggtgcaaagttaaataactcattgcaaataagctcatttatttgctttctttgtactgtttcaacttgatttaaaatgatatttataagcttaatcatctcttctttattaaatgctctagttttattactgcactattaaaatagattttactatacctatagcctctacccctatcattacgaagcttaccctaattacatctcgcctcttaaacaacaaaaaaggcttacatatcttaatacataaaccttttacacatcatttttactttaccctcaatttctgtccaacgttaattaaatttctattggctatattatttagcgctaccaacctatctacagtagtattaaatcttctacctatcccccataaagtatcaccatacttaacaatacaatattctttatcatcattactagattgttcatcttctgctaaagcaagagctgtacatattcctctgtatattgcagctgcagacttttctggattatagtttgccatatcagaactactgtcaacaaaggcacattcaacaattaatgcaggcattgaagtattattaataacatataaattccttctatcctttacacctctgtttttaagtccaagtgtagctaactcttttaagatagcttctcctacctttgttgatagtccaccttggtagttacctttaatacataaaacctctgacccatatccaccaaggcatgcattatgatgtattgatacaaacaatgttgcaccagaattatttgctgtatttactctttggtacaatgaatcattaagactttttgcagtactaggtgtacaattcacaactttaatccctctttccctaagcttacttattaatttatttccgaccaatctatttagattattttcattacatattcccactgctcctacatcataaggaacattatgtccaatatctattactaatataatttctttcataaaatttcacctccaaataaaatatagggcttaaaaccatatatactaagaaaggggatgattttttatgaattttaattatatagaaactttagttactaaagctaaaaatggagatgtagcagctaaggaaattatttttaaggaatttagacctatgatattaaacctatcaaaaagaacctttgtccatggatattatttttcagatatatagctttaactatatttattttaatctaatcactttcaatcaaattaagattatttgcaatttcactttgaacacactcttttaatttcttcttacttattgtttcaataatcatatctatgttcccatcatattttattggaataacatccaatacactagtaaaattatcattaggaataattatatcatctactctcctaataaacctttaaaacaatatatctttttagtcaaaagaccactagcaaattttaattcgtcgctagtggcctaacatatctatattctaaactaatttttgctcaaaaatattatccaaattcaattttttaatcctatcttcaatttcagcagtatcaatagtatacaaacctaactcttgcattctcttaaaataactagctccagcaaaagtatatctatcctttcttcgaggtctgttatatcaaaatgttgttaacaacattttgatataacagacctctatgtgaataaatgtattatagttaaatagcttgataaataatataatcaataaagtatagtttagcgatatagtgacaaaatcacctttttattaaataaattataagttgaaaatctattaaaaatttcaagagttataagataaagctattttagagcggtgtataaaaattttatcagtttctaaaatagcttttaattttatcatataaaaaataattcaaatttaatatataagagtttttaatttatattatgcctaaaaatattcaattaatataatttttactaattagtctattattttttattaaaaaattaataataaaggtcattttttagggggaatgtaaatataaattataaaaaagggggaatggtgtgtatggtcattaaatattaatatagtaataaggttgaatgaataagtgagataattagatttaatattttgtaatggtaatatatttatgatataaattgataactgcagtaaaaaaatgggtttttattctaaattaagatttgattttatatgaaataggaactagagatatatttaatgtcaatatggtagcaaataaatatagagagggtattaaggtgtctatggaagaagtaagggttgatttagatgaatttttggaaaaggtaagaaatatacaattattaaatattcaaatagtaacaaaattaaatgaaataaaagaagaaataaattcattagattttagtagtcaaaatcatagctcaattgaagtaaaaaggaactttaataagttagaatctaggtttgaaaattataaaaatatgataggttcttatggaattttattagatgatatgggtaagttttattaaaggtatgaatagaggataaataatcaatagggcataactcttgattcaagtagatttcaatgaagtagttaatttgaaagttaaaataaatatttgaattaattaataaagtaagataaaagaatataagtgatattattaaggggcgcaattatatacagaattaagttttatataaataattagtggggcaaattttatataaatgtattttaatatttaaattatatattagtacttaattatagcgatcgtttatagtgttttaagttataagaagtataaaatatggggcaaattttatggtagggaaatgaaattgaagtcactgttgcatctatggaaagcaggtatataagggttatatgatacttatgggattgtgtagcctatggggtttggtagactgtagcaaaaatgaatcagttaaagagtgctttaattagtatttgatttaattattaatctaatatttaatgatcatattaaataatggacctgatatttttaatcaggtctattatttttagagaatattaggatagttttattaatttataattgcattatttaattgataaattggtcttagaataacatagggtatggagaaaatgaaaaaatataacattaaattttaaaactattagtttgtattatgtgtgaaaaaagtatataataattaagttaaaatgataaaactgtcaataatatagttattgttatttattgctttgatggttattcttaaatatactttgatagttaatattaaaggtattaagaaaaagtttaattttaaaacaaaagaaatttaatttaaatttatatataaataattttaggaggacataaaattggctgattacataaatgagataaaaaagagaagaacctttgcaattatttctcaccctgatgctggtaaaacaacattaacagaaaagttcctattatacggaggagcaattagacttgcaggttcagtaaaagcaagaaaagcatcaacgcatgctgtttctgactggatggaaatagaaaagcaaagaggtatttctgttacttcatcagtaatgcaatttaactattcaggacactgcataaacattctagatactcctgggcaccaagacttctcagaagatacatatagaactcttatggctgctgactctgctgtaatggtagttgacgctgctaaaggggtggaagatcaaacaagaaagttattccacgtttgttcattaagagaaatgccaatattcacattcatcaataagatggatagagaagctcaagatccattccaactattagaagatattgaagctgagcttggaattaaaacttatccaatgaattggccaattggttcaggtaaagactttaaaggtgtttatgatagacaaaatcaaagaatcatagcattcaatggtggaaatcacggttctacagaagttgaagctattgaaggttctgttgatgatgcaaaattcagagaaatattaggtgaagcacttcatgataaattaatggaagatattgaacttcttgatattgctggtgatgaacttgatatggaaaaggttagagttggggaattaactcctgtattcttcggatcagctttaactaactttggtgttgaaccattcttagagcacttcttagaaatgactacatcaccacttgctagaaactcaaatattggagaaattgatccatttgaagataaattctctgctttcgtatttaagattcaagcaaatatgaacaaggctcatagagatagaattgcattcatgagaatttgttctggtaaattcactaagggtgaagaagtattccacatgcaaggtggaaagaaattaaagcttgctcaacctcaacaattcatggctgaaaacagagaaattgttgaagaagcatatgctggagatattatcggggtatttgatccaggtatattctcaattggagacactttatgttcaccaagcaaaaagttcaagtttgaaggaattccaacattcgcaccagaacattttgctagagttagaccagttgacactatgaagagaaaacaattcgtaaagggtgttactcaaatagctcaagaaggggcaatccaagtatttaaagaaaaccatgttggtatggaagaaataatagttggggttgtaggtgtacttcaatttgaagttcttgaatacagacttaagaatgaatacaatgttgatatcaagatggatagacttgcatttagatatgtaagatggattgaaagctatgatggagatgttgatagattaaacttaacttctgatgctaagagagttaaagactttaaggatagagaccttattatattccaaaatgactggggaattaattgggccttagaccacaataagggattaattctttcaggcgttggtaagagtgatgaataaataaaatattaaattataaatagaacaaattgtatttaaaatacagtttgttctttttttattatttagaaaattataaggcttttgtattagtaaagtttgtgatatcaacgattctgaagttagtcaactgtaaacctgataccagtaaattagtatgtataatcagcttcatccttactaatttataaaatagcaaagttaataaagtaagttattttaaacaaataattaaatataataattacaataatatggaaaatatacaaaatatatggtaaaatgtgtaaaagtgataatatcaataaaaatgaaagggatattttattgagagttgctagtaataatttagctattgaataaataagcttaatatgtagggcaaaattagccaaaaaattatttgtttaaactaaaggggagaagaggtatgaggaaactaggtatgggaaaaaataaagtttttaataagtgtgtagtaacagtttttacattatttataattattgcaacaatatctacatcagttaaggcagaagtgagaaataataatatagtaatacctaaaactggtgatgatgggttaggattagtgattggagtattaatattatctggagcagcattattagttgcggttaataagcaaaaggttgaaagtagggagtaaatttataaagtatatttaagcaatttataagttaacatgataaaataaaagtataaaacataaattgtaaaaaaggaaaatatatgagaaaaataattaacattatattagtagttattattataggatgcttaagtattattggttataagtattataactatagtaaagataataagttaaattcagaaatacaggatcttcaaccggtaattaatgaagaaggtttaggaaatactgattcagatgatgcaggtaataattctagtgaggagaatgatggacaagacagtagttatgtaagtaatagtgcaaatgaagatgaattaaaatcaataaatagtgattataaaatgtggatacaaattgaaaatacaaatataaattatccagttgtacaagggtcagataatgattattatttaaagcataattttagaaaagaatctaatatttcaggaacgatttttgtagaaagtgcaaatgatattgataatgataaaaatattattttgtatggacataatatgagaaatggaactatgtttaataatattacttcttataaagaggaaagtttttttgaggctgataataggattaacataataatgaataataaagtatatgaatatgaggttttttctgtttatgcaaagaatgtgaatgaaattgatttagctattggatttgcaaatacagatgaatttattaattatgcatataatgaggctgagcaatctctttataaaaaagatgttaattttagtgaaaatgataatcttttaactctagtaacgtgtagttatgagtttactgatgcacgaactattgtggttgctagaaggtgtgattaggacatataggtctgttataccaaaatgttgttggatgatgctatatgaagaactggtatacaaaaatattgttggagattgtatgaagcgctattatagcaaaatgttgttggttataggaggcaggattgttatataaaagtgttattagtaatagaagtaggtatgttatggtaaagtgttttgtaagagcatatgattctgttataccaaaatgttgttaacaacattttaatataacagaatcatatatggttataaaatataattgattcacctaatgaaagtaattattttatctatatctcaacatagagttaacaggtagtaagcttatttaaaaagaaatataatatttgataagtcataacagtattttaattttaaataataactttaagaaaaaaattaaaattactatttgaaagtgttcataacttaaaataacatagaacaacttataaatagtaaataataaacaatgaacaataaataataaacaataaatagtaaataataaatcaacaattccaaagatgcgcaggtgagataatctgggcatttttttataataaatttgctttgttatctcatcagatttcaaataaatatctattttagaaggtagtgatagtaatttatctttattgctattatatttatcaatacatttctttattgaatctacagttctagcactaaagtattcgctgagtttttcatagattaattctaaatatttatcatcatcgtttattgaaacataagatagttttttagatatggactctaaagatgataatacattttcatcaaatcgataaagagtagtaggttttttaaaactctcatataaataactatagtcaaacttggtaaattggtaagttaatgaatgagtatattaatgaatgggtaaattgatagttaatgtagggggaaatcggtaaattaaaaagtcgataaattagtgaatcaatatgaaacaaatttgaaaataaaaaatatttttaatgagataaaaagtatatattttcatataaggccaacaataatattaggaattatgatagtgtaaagcttcgtatgaaaaatatcctatgactaatttttaataatagctaaaaataactttaacggaggtgtactaatgaaaagaattaaggggaatttattgattatcattattatgctacttatattgactataaatttggtaggtactgtttatgcagagcctttaacaagaagtgatgggtcaattagggttgaaaatgtagcaggtggtcaatcttataaaagttcaagattaaaattgcaaaaattaaattatattaatggaaatagtgaaataaatagtgttgattttcaagatggtaaggctgtagctgtatttgctgaagaaaataacttggaaaataacttggaaaatgatcttaacaataaccttaagtatgaaaaaactagcttatcaaaagacattaatttagtagaggatagtaatttattagaagataacattgaacctttattagtggaagatagcattgaacctttaaatgataatatttcttctagtaatagggtagaggatatatcaactgtaccaaataaaatggtaattaatactggcagcaaggtgcttggaaacattgggtatgaagatttttatttaatagcacacaagattactacagaagtaggaccagcatattgtttagaggttgaaaaggaatatccaagtggcgaaaggtttgaatttcagggaacaccagaaaagaatataattggaatgatggcagctggatatcctaataaaagtgcagaagaactaggcgcggtttcagatgatgcagcatattttgcaacacaaatggcaatttggtgtgttactgaagggtatgcaccaaagaagtttaagagtagtgataaaaatatgctacaaactattaaaaatatatatgaagaaggaatgcaatataatggagaagatgtagggcatattgcaatggaatattattatagtgatggggtacaaagaatagttgcatatgttttaaatagggaagaagttactccaccatctgaagaaataccagttaagccaggtgaaacagatgattcttcaggagattttgaagaatggccagatattccagatgatgaggaaataatagaaactcctagtgaagtggaaagtgaaaaagtagttgttcccgggttgggttaactttaaagtttgaggagaaaaagacctcctaagcaaaaagcaaacagtaagattaaaagtttttactgtttgcttttataatatttacttatatattctattttttgtatatagtttgtttttggtaaagaataaatcttattgtaaaagggtatattcacgtaagttttccaattgtcgttatcatcttaaagaacaaactgtattcttttggattaaattattaaacttggatgcagtttttagagaattatttcaaaagaatagtaagtgggatataatatagttattattttaaagaaaatataaaatggaatttatgtaaaggcgggaagggaataggcaatgatagatatacattcacatataataaatgaaattgatgatgggtcaaaaaacttagaaatgactatagctatgttaaaaaaggcacaattaacaggaactaaatcaatagtagcaactccacattttatgagaggaagatttgatgtagaatacccagaaattttagaaagagtagaagatttaagaaatatagcaaaaaaaaataatatagatataaatatatatgcaggtcaagaagtatactacagtagttatcttatagaatactttaatgataaatgtattgggacaataaatggatcaaggtatatgcttattgaacttccaatgcttgagtttaatttagatgaagttattaatactatttatgaacttcaaataagaaaaatagtgccaataattgcacatccagaaaggtacaatcaatttattaaaaagccttcaatgattaatgctcttattaaagaaggaatgttatttcaattaaatgctggaagtattactggtagttttggtaaagctgttaaaaaaactgctcaaaagtttttagaacataatgtttatagctttattggatctgatgcacatagggataggggaagagatacagatatgagcgaagcccttaaacttttagagaggtctcaaaaaagagctttcattagcaatgcaagtgctatgattgatgatgaagaagtattatttagaggaactgccgttaaggaaaagaagttcttagggattttttaaggttgcatattttaaggagatataagtttaattttaatagttttaagttatataaattaagcgtcatagtttttgatatataattgatagaagcagaattttatatgcaatataagataaagcaatgaaatcaatttaagaagaatataataaatgtaatgtgaaacatatatcatatagcaataaagtatatataagtttttaatatataaatatctacattatatagatagttttatctatcatattaatgtagatatttttttatttaagattaactctatgatatcaatgtagatatttttttatttaagattaactctatcatattaatgtagatattttttttatttaagattaaccttgcttagaaaacatttttttaataacaattctatttactaagctttatttttagttttgataatagtgatatcaattctcttcttttcttatggtaatttaaattgtttttagtgcaatatttataaaggtttgagttttcagtgagataagctacttttataagaaaatattcttctggagttagtgagttaagtaaattttttagagtagtatgttgcatagtttcaattatgtgattttctaaattataatcatcaggtaatagggattggatatcattattttcatcgacttcaatattaaggctagattcgctttgatattttatattagcacgagctaagtttctataagtatttttaattgaatttattatatagcagtcaataaatctttcaccgtgagacaaatcatatttttttattcctttaattactgctatagttcctacttgaattaagtcttcactttcatagtttttcaatacataagatattgagtattttatcataagtggtttatatttattaattaagaaaagtatggcttcagtgtccttatttttagcatctaaaattatatcaattaattttttggatttagatttaattgtattattagaatcattcaaaaagtatcaccccattcttatatttaatatattgcagaacatttgttctggaatatatgttcattatactacatggtttccagtatttatataaaagatttatatttaatatctacaaagtaatttaaatgttgctaaattgttaaaattttaaaaaaattactgcaaattaagacaagttaaaaaacatataaaatatagaaataagcagaaagtaatattaaatatttagtaaaaaaataattaatataaggcaaaaaaaggtgtgagcaataaaaaagttataaaatattgaaaaaataaaagatacgtttacattttccgacataataagggaaactacatttttttatagcaaattttatgatataatgtcaattgtaaaagaaatattaagataatattaagaagtttgacaagaaatattaagtataataaaagatttatagtaaataaaaaaataaaaataatggttatggttgtattaagttttattttaattagtaatttatatacaacctttttgtatgttgcaataatatatgcaaatacagagttgtattagatttagtattaaattgtaattatatatcacgatatatacttagcgtatagttaaataaataatttttaattatattaaacacattaattattggaaagtgaaagttaatataaggggaccataagatgaatactttaataaatagttgtaaatatgtagttaatgaaaatattcaaaatatatatagaattttttgtatagttaaatatgaaatcttagccgaaaatagagattcaaagtttggtatgttatggagtgttttagatccattgattcaaattttcgcatattggtttgcatttggaattggaataagaggtggtaagcctgttaatggggttgaatatataaattggatgttagtaggacttactccatggttctttttaagtgcagcaatacgaaaggggacaagttccatacataaaaaaattaatataattactaagatgaaatttccaataagtattttaccaacaactgtagtatttaaggagttatttaatcatgtaataatgcttgctgtaattataatttttatatcaattaatggagttacattaaatttaaatagtttatctttaatatactatattttttgtgcagtagttttttcaatttctttaacaatggttacttctgtggctaacatgtttacaagggatgtaggtaaggctgtaaattcgtcaatgaggttattgatgtttattacaccgatattatggactatggacaaattacctaaatgggcagtaacagttatgaaatgtaatccactgttttatattacagaagggtatagaaacagtttgctttttaataaaagtatatttttatattcaaagagaatgttagtgttttggataatagtaatatttttattttcaattggaagtttattaatgtacaagtttaaacataagtttatagatttaatataaatggagtaaataaaatggaagaaaattgtgttgtagagtttaaagatgtttgtaaaatatatgatttaaaaagaaaaaagaataagaataataatggtattgggaatgaaggcaaacaaaaattttatgctttaaaaaatataagcttttctataaatagtggagaaatagttggtatattggggagtaatggttctggtaaatcaactttatcagcaatgattgctggaatatcaagtccaacatctggggtagtgaatataaaaggagaacaatctttaattgcaataaatacagggttaaataatcaattaacaggtttagaaaatataaaagttaagggggctctacttggattatctaagtcaaaaattgatgaaataacacaaggcgttattgatttcgcagaattaggggatttcctttatcagccagtaaaaagttattcaagtggtatgaaatcaagattggggtttgcaatatcaataagtttaaatccagacataataattattgatgaagctttatctgttggagatagcggatttgctgctaaatgtataaaaaagatggaggaattcaaaaactcaggtaagactatattttttgttagtcattctttaaagcaagttaagagcttttgtaataaagcactttggattgaggggggagagcttaaaaaatatggtgaaatagaagaagtagcaaaggaatatcatacttatattgaagaaattaaaagaaaaagtaatgaagaaaagaaagcctttactgaggcaatatttaaaaaaagattagtcaaagaagatgagaaaaaaacattaaaagatagaattaaatttaaaaatataagtaaaaataatgttttaactactttatattctaggttaagaggaatattaaaaaaatatacagctatcattacaacaatgataataacaattagctgtttaagtataattgggattgcaatgattaataatgataagccaaatacaccaatagttcaggaagataatgagtctaaagaattacttgtaaataaagaagaaataataaaaaatttcaattatctatttttaatacaaggggaagaaatagatgagtacaagaatcaatatagaagttatttaaacgagcagagtggaaaaacaatttttgcaattattaatattgaaggagatagtgaaggaaaggtaagtataactaatattccaatttctcttcagttttattatgaaagtctaatgttagtagatgagataaggttttgcaatgtgttagattcagagattaaccttaataatattgaaaaaaatgtattaggaaaagatgttgatgaaatatttattttagaatctgaaaaattaatagagtttgctagaaatttaggagtgaatttagatattaataataatgattttatttgggctatagaagataaaaactatttagtgaatcatggggttattagcgaagataatacaaataattttaaagaagtatcaaatgaaataataaatagaattattagattaacaagtgaagataaaaatagatatctaggagagttgttaaaaaataattttgaaaaaatgcaagatttcttaggggatacggaaaattatcataatgagaatatagatattagcttcagtgatattacaacagaaaagttagttttagaaaatctaattacaaatgatgaaattaatttgataccagagagtgctttattgaaaagagagattgtagtatcaacaagagagtgtataaatggaaatatatattataaagctatgattgatgaaataaataatgcaaaagaagaaagctatggtgattcagatgtgaatagcaataatgataattacaatactagcaacaatggacaatcatcaaggaacaatgagcaaccttccatacaacaacgtccaaatactaattcaggggtaacaaatactccaagttcaccaagtaattcagatacaacagaaaagcctagtactccagaagtgccaagtgatcctggaataccaagtgagccagaaacaccgagtgagccagaaacaccaagtgaacctgagagaccaagtgaacctgaagttctaaccgatcctgaaaacacaactgagtctgagacagaatatagtactgaaatgtatattgaatgattaagagagagtagtgtatttattaattagtatattagaaaaatagatattaattgatagaagggagcataaaaatgaaaaaagttattacatatggaacatttgatttatttcatgttgggcatttaaatattttgaaaagagcaaaagaattaggggattatttagttgttgctgtatcaagtgataagtttaatagaaaaaaaggaaaagaagcatatcattctatagaggatagagtaagaatattgagtgctataaaatatgtagatgaagttattatagaagagtcatgggatcaaaaagcttatgatataaaagaacatgatattgatgtgtttgttatgggtgatgattggagtggaaagtttgatgatttaagtgagtactgtaaagtaatttatttgccaagaactgaggggatttctacaacaaaaataaaaaaagatttaaacaattaggagagtttaataatggaaaataaaaaaaaaaatgaaatgaaagagaagaaaaggggattttatataagaaatttagagatagaaaacaataaattatattttcaagcaaatattaatctaaaaaactatagaaatgttagattttatttaaaaaatagaaaaagtaaagttgtacatagattaattgatgaggttagtatatctgataaagtaataattgattttaataaattatgtatttcgttctttgaagaaaaagggatttgggatttgtttcttgatgtaggaaatgaaaatatgatgtataaaggtatcattagatataatgagaaatatcatgaattgggtaaaaaagagtttctagaaaatatttatgaagataatgatatggctggatgtatatatataactgctaaaaatgagatctctttatatgttaatactataaattctgtattaaacaataagtatagctatgaaatttcagtagataagatagcaataaaatcatcaaaatatattattaatggtagtttagagtttgatgtaaaagaaaatatattaattaattatgctgtattaaaattaaggaataaaacaaaaaaagcaacggaattaatactacctgtatcagtaaaatataagaaaaatggaaatattaaatattccataaattttgatactgataattttaaatatgatcaattttattgggatttatatttaaatgttcaaatcaatgacaaatttatgagaataaatgtaaaaaatccatcaaatagagttattaattacattgataacaatacaattaaatttacaaagaactttgaaggtaataatatattatacccatatattagtgcgaaaaatacaatatgttttggatatagacaaagaggaaaatatgaaagcagacagtataagatcaaagaaaaaattgctagaataatatataaaatgtttaaattttatcttgataaacaacatatatggattattactgaaaagtttgctcaaacagcacaagataattcgttttatttctttaaatactgttttgaaaatcaacataaaaagaaagtttactacataatagataaggattctatagagtatgaaaagttatcaaaatataaaggtagattattagattttatgagtattaaacatttagtaatacttatggcatcagaattaataatatcatcagaatcgagaattcatgccaatgcatggagggtacaaataggacatgcaatgagaagtttgatgaataagaaagcagtatttttacaacatggagtaacagcattaaagagagttgaaggaacttataaaaaaggtaatactggaggggcagatttatttgttgttacatcagattatgaaagagaaataattaaaaaatattttaattataatgacaaagaaattataaatacaggatttgcaagatgggatgtattaaaagataaatcaggagaaatatcagaaaaacaaatattactaatgcctacatggagaaattggcttgatgaagttagtgaagagcaatttgaaaattcggattatttcaagagctatatgagtattattaactctaaagaattaaataaaatattaagagataataatattattataaattattatgtacatccaaaatttcaatattatttagataaatttaatactaaatttgatagaataaaagtaattactccaggagaatatcaagtaaatgatttattaatggaatcatcgttattaataactgattattcaagtgtatcgtgggaaatgtatcatcaaaataagccaacattattttatcattttgatgttgaggattataagaaatatcaagggagtttcttagatttagataatgaattgttcggggaatgtgcaaagaatccagaggaattaatagaaagtataaaaggatatattcaatctgaatttaaattgccacaaaaatatgaagatatgagaagtaaatatttttcctttgtagattctaaaaattgtgagagaatttataatgcaattatagaaaatgaagaaaatttatttaatggtaaaagtaataaaaaaataatattaagtaaaataagaaaaaataaaattgtaaaaaaaattcttaaaaataaaaagataaaatctttagtaagaaaaataaaaagaaaattaataacatagtattaaaaaatagttttaaataaaaaaatatatagaatgaattttttttattggccatgttttaaagaatatttcgtattgagtataagattggtagactattaatgacattcttttagatagaggactactgttaaaaaagactttcttaaatatggctaataacttttaaaatagagaaataatgagatttgttgttactatataaatgtaaaataaatattttgtttttatataatattttttcaattatatgtatttaagcaattcatttatgattattaaaataaagatagcgatgatgaatttaaactttaaatatattgttaattagataaggggatatagagtgagtataagatctaaaatgaaaaaaatttttcttgtaactgtaaagtatgcttataatatattttataaatatatacctgttgatgagagaactattatgtttatagcatatcatgggagaggatatttgtgtaacccaaaatatttgcataaatatatgattaatgatagtaaatatagtgattataaatttatatgggccgtaaagaaagtagataatgtaaatatatcaaatgcaaaagttattaaatataatgggcttatatattattattatttagctagaagtaaatactggataataaactgcaagatgcctaaacatgtattgaaaaaagaagagcaaatttatcttcaaacttggcatggaacaccattaaaaaggttagctcatgatatagaaattggtgaaggagcatcattttatagaacaaaagtttctaagagagaaatgactaattcatatgatagtgatgttagaaagtatgattattttatatcaccaaataaattttcaacagaaaaatttaaaagtgcatttaaagttaatgaaaatataatacttgaaagtggatatccaagaaatgattttttatctaatattaaagaagatgaaattaatagattaaaaataaaatataatatcccattagataaaaaagtaatattatatgcaccgacttggagagataattcatataacatgaaaggttatgtttttgaacttaatgtagattttaatttatggaaaaaagatttaggaaaagaatatgtcgttatatttaaaccacattatttaattgttaataaagaaagtaatgaaagtttagaaggctttttatatttgataaatcaagatgaggatattaatgagttatatgttattagtgatatattggtaacagattattcaagtgtattttttgattatgctatattagaaagacctatatatttttatatgtatgatttaaaagaatatgaagaaaatttaagaggtttttatctaaatatatataaagatttgccaggaaaaataattactgaagaaaaacaattgttggaaatgttaaagcaaaatgaactatatgttgaatcaaataaacaaataattaaagatttcaataaaatatataacaatttgcaagatgggcagtgtagtaagagagtaattgaaagtatcataggatgatttgaatagagggcatataataatgaagagaattatagtttatattatactagcttttataaataaaatgttattttggtgtaaaataaaagaaaataaaattacgtttatatcttataaaagtaataaacttgaaaaggactttaaattaatttctaaaaaattagaaaaagaaaataaatataatttagtttatatattaataaaatatgaaaataactttggtgggaatattgcatacttatttaattgtattaagcaaatatatcatattaatacatcaaaggttgttattttagattataataactttgtagtatctcattttaagaaaaaagaagttaaggtaatacaagtatggcatgctagtggtgctattaaaaaatttggaaatgatatagaaagagaatatccaataaaaaattatgattacgtcataagtacttctagtttttggaagggtatatacagtacagcattcaatgtatcaaaagataatgtattaccattaggtattccgagaactgatagtttatttaataaaaaaagattagaaaaatataaaaaaagtatacttgaaaaatatcccgaaataaaaaataaaaaggtagtattatatgctccaacatttaggggagatccaataaagaatgtagaatatcaagaaattaatttaaagtatataaaagataagttaggtgaagattatatattaatttataagctgcatccttggctagaaaaagtaagtatagtagatgaagatggaataataaatggaaataaagaaggaataagaaaattattttcagttacagattatttgatatgtgattattcagctattatttttgatttttctatactaggaaaaccaatgattttttatacgccagatttagaaaaatataaaaaagacagaggtatatatgaagactatgaaaaaattatgccaggtcctatatgtatgaatgaatatgaaattgttaatgaaataaagaaaaacaaaaattataattatgaaataaaaaaatttaaagataaatattttgagcatcaagatggaaagtcaacagaaagagttgcagaatttattaaggaattactttaagcatatataaatattgtgaattttatggtaaaagaatagaatgggactagcaataggcatttaatttactaatataggtgttgacaatattaaaaaaataatacctttaagattacatttagaataagtaagaaaaaaatttaaatatttataatattaaaaattataggaaaaatttatggaagtttttatatagttaagagatgaatataaatagttctatatatttataatatcctaaattagcaaagctgatttaggatattttttttatttattaccaattaatatcaccaacaattaactataaagatggaaaattaatttaaaaatgaaaatacaaatcaatcattcctaaaagatacaccgcttttatacaaaaatataaaaaatataaaaaatagaattaaatgtaatgaataatcaaaaattacttttgaaacttttaaatttttaaaaaaattttaaaaaaaataaaacaaattacgacaaatggaaactgcttttttataaataaagtgaaagtaaaaatatatgttaaagaaaaaagtgaattaaattaaaaactggaaaaaattttaaaaaaaattgtacaaattacaacaaaaaaataatattatacgtttacatcgacttgttttataatgaaatgaggaatttttcctgtggaaaattctatgctataatatcgatgaaagtaaggaaaagttatatagaaacaaatagggggataaatggtaactgttgtagattatttagatgagataaaaaggaaatggaagaatattatcttagttattttatgtttcttattaattggaggtatatatactactttttttacaaaacaagaatatgaagctaaggttaaagtttttattggtaaacaaagatttataaatgttgcaggaacttatgataatgaagaaattactttatatcaaaggctgattactacctattctgaaattgctaagagtaaaaaacttattagcaaatctattaatgattctaaagttaattacttaagtgatagagatggaaagataacatattcatctgttataagtaatttcactgttaatcctataacagatactcaaattattgaacttaaatatagtagtttaaatccacagcaaagctatgatttactttattcgatgacagaaaatataattgcgtattctaaggaattatatccaactgttaatatcaaagttgtagagcaagttcatgttgattatagtgatttaattagtaaaaagattatgattgtgggagctgcattaatattaggattattaacaggtataggcatagtaattacattaatgtattttgataatacttttaaaaataaaagagtcttagaagaggaaataggaatttctgttattggagttattcctgattttgaaggctaaataataattaataataaatataaaaatcaattgtgataagtgaaggtgaaccgtggcaacaaagctttaagtaacaacttgccacttatcacttattatttgtcacttgcaaaagggagtgtagattaaatgaatgaaatggaagaacaagtaattagtctttcagaaatttttgatgctttaaaaaagcgttggattatgatagtagcaattactttaacagctactatagtatcgggaattataacattctttgttatcgatccggtatatgaaacaagcactaaggtgtttgttggtaaagaagaaaatgatgaagtagcatatagcactaatgatattcaaatgtatcaaaagttattacaaacatatgctcaaactattaaaactagagatttagtttcaaaagcaatatcatcattatcttatgacttagaagcaagcagtgttgttggagcattaactgtaaatcctgtagcagatactcaaattcttgaaattaaatatcaaagtaaagatccaaaagaagctaaagatgttttaaagagtgtaacagatgaatttatagtaacagctaaagaattggttgctaatggaaatgtaagagttattgaagaagttgaacttccagaaaatccagtaagtccaaataaaaagatgaatattgcaatagcatttttattaggccttatggtaagtttagggatagttttcttacttgaatatttagataatacatataaaaataaagatcaacttgaaagagaattagacataccagtaattggagtaattccagatgttgatttagtataggaggaaagagatgtttgtagttgaaaaaaatccaaagtcagtggcagcagaagcttatagaactttaaagactaatatccaatattcttctgttgataaaaagtataaaagtatagcagtaactagcgcaaacccaggggaaggtaagtctattactgctggtaatttagctttaactttagcagaaggagaagcaaaggttcttattattgattgtgatatgagaaagccttctatgcataaaaattttaaaataactaacacatatggtatttctgatatcttacttcaaaaacaaaaggttaaggatgtagctcattgttataataaaaatcttagtattataacaactggaaagttgccacctaacccagcagaaatgttagcatctaaagcaatgactttatttttagaagaaatgaaagagcattttgattatgtaattttagatacaccaccacttcaagcagtagcagatccacagattttatctactaaggttgatggaactttagttgttgtaagagcaggaaaaactaagaaggatgatgttaataattcaatttctttattaaagaaggtcaatgcagatattataggaacagttcttcatgctgttgataagagtaagaacaaatataactactattatggggaagataaatagaattcttggggttagaattcgttatatccaaagggaatctagtatagaggagtataaattgttatcacccatctaaataggcggaagtgttataatggctagctatcagataaataacactttacaaattataatattttaggggtttatatatataagtaaaaaataatgaagcggggggacatgagtgaaagggcttgaatttgaatttgagaataaggaagagatcaaagaaggctttagcttttatgaattttgtaaaaggggaatagatattctaggagcaggaagtggaattgtcttattaagtccagttattgctgtagtagcatgtgctgttaagtttacttctaaaggacctgtatttttctctcaaaaaagagttggtaaaaatggtgaattatttgatatgtacaagtttaggtccatggttgtaaatgctgaagagcttaaggaaaaactagcacatcaaaatgaaatgtctggacctatgtttaagatgaaagatgatcctagagtaactaaggttgggaagtttattagaaaaacatcacttgatgaacttcctcagctttggaatgttcttaaaggtgatatgagtttggtaggaccaaggccaagcttacctaaggaagtggctcaatttgaaaagtggatgtataagagattgagtgtaaagccaggacttacttgcttttggcaggttagtggaaggaataatatcgactttgaagattggatgaagcttgatattaaatatgttgatgagagaaatctttggattgatattaagcttatatttaagacggtacttgtgttgtttggggataaaaatgctcattagtgacattaaataaatagtaattaacaaatgtaggaagtacggaaaattaagactttaagcagagactgatggagtcttttggataagtttcgagtttttaacccataaaactacaaatatagaaaaaaataaaatagaaaaataaaggtaaataatgattaaaatatacaaaatttataaaaaggggaatggtaaatgaaaggtattattttagctggtggatcaggaactcgtctttatccagtaacaaaagcaatgtcaaaacaaatggtgccaatatatgataaaccaatgatttattatccaatgtaaaaaggagttgtattcagattgaatttattaattcaatctgatacagcccctttatacgttaattaaaatttctgaacatgctttataaaaataatcacttctactaaactttaattaaattatttatctaataccttatatattttcatatttatttaatcccttatttttatacaattaaatgtttttaataatataaagtagacaactccaacacaactaattactattattgtgtttattccaattactaaagtatttctagctaacaaattccatattaatctgccaaatatagttgatattaacccaaagattataggcatgaatgcccaatttaataaatctattttaatatcagtaaccttaactatagtaataaaacttactgtaaaactaaaaatagttgatatagacattgctataattaacccttctattccctttataggtactaaaaaatatatacttaaaatctttaatattgactccattatttgatattccaatactctaaactgttcatttaatccatttaaaattccacccataatcatatctatatacataaatggaattataaaagaaagtattttaaaatatgctcctatatcttctctattataaattgatatagataattgattataaaatgtgaaaaatataaagaaagatataatacctattatactggtaaatccaatactcctgttaattacactatttaacctttctttattattaatagccttagctctagaaatctctggcatcaaaaccctagctaaagacataagtaatgttgctggaaacataattatgggaaaaaccatccccataactccacctaatacacttatagcttcactttcagacattccaaaccttacaagagataatggtattaatatcatttgcactgtactaaatgcagacattaagtaggatctagtagccataggtatagatattttaaataacctttcagtcaatccttttgtatttccttgtacattacttaaatacttaatttcctttttctccaacttatatgctataaatacatataaacaagataaaatatcacttataacacttcctaatacaagaactgcacaaccatattctaattttatagatacagctgaatgtaataataatactattactgtaatttgtataaacttttcagcaagctgagttgttattggtataaatatatctctaacagcataaaaatatccctttaagcaagatgatattgaaataaaaggaatgcttattgcaaatatttttaatgaaagtattactcttgtgtcttttaaaaatattaaagctatatttttagaaaaagtaaataatataatagaagctgttattcctaatactccacatattgtacatgctttaaacaccacatattttacattattgtactctttctttgacatttcttctgctacaattcttgttactgctgaacttattcctgaagttgaaaaggttattgcaatcatacttactgttccaataagcttgtacaatcccataccctctgtaccaatttcattggatatgtatacattaaatacaacacctatactcctcattatcatcattgtaattgataataatattgcatttataaataaattctttgttttattttccatacagtacctcttaacttattctattgatactatatgttaagtgtttacaataaattacttatattaaattaaggaatttaaagtttataataatttaataatatttcaatttttttctttatattttacaagcatttcatcagtgatttctaccttactttctcaaattgattcattattatccccaattaatactgagttatgtcaccacattatacttttatctttggtcttgattttctttaccattgatttattttaaaaaatttatgatataatggtttaaaagtttaaacaaaaataaaaaaatatcataaacagttaagatgctttataaacctgaaaataaaaatatatgtattccatacaggagaagttggtattgacactgcagtgccatttcgtgatacatcaaaaaatccaatatcctatactggactttttcaaaaccccaaaagagtaaagatgagttatctgctgtcactaaaggtcaaataagatattctaatagattatttaaagatataaatataaaaacatttgaaatggaaccctcaaagtacggaccatttaacagaagctatgatgtatttggagatagaacagtattaatggtagatataaaaggacactcacaaggaacagcagcaactttaattcaaaacaatggaaagtttgtacttcttacagctgattgtgggtatgcaatagattctttggaaaatatgagacttaaaacacttcaatgggttagagatatggttcataaagaaaattgtataaaaattatagctaatcattatcctgagatagaaccacaaactattgaattgtaggaggtgttttatggatacaaatgaaaaacaataaaaaaaactatcatccttagttaataatatttatgatcttgtaaaagattttgcatttaatcactaaagtaatatggaggaatagattatgaaattaatattagtttgtttgatagcaggattaggtgcaggaataggaactggacttgctggactaagtgcagcagcagttatttcacctatgctgattatgtttcttaatgttcctgcctatcaagctattggcattgcattagcatcagatgttttagcaagtgctgtatcagcatacacatatgggaaaaataagaaactagatattaaaaatggacttataatgataggaactgtattaatatttacactaataggaagttatttatcaaacttagttccaaataaagtaatgggtaacttttctatgtatatcacatttttagtgggtataaaatttattgtaaaaccagttatgacaacacaagaagttatgaatgaaaagtcagaaaaaacaaagataatccagtcaatactatgtggaattatagtaggatttatttgtggatttgttggagccggtggaggtatgatgcttttactaattctaacaactgtcttaggttatgaactaaaaatggctgttggaacaagtgtatttataatgacttttacagctcttataggttcattatcccattttgctcttgataaaattcctgatttaaagatattatcattatgtatcatttttacatttttaggagcacaattagctgctaaatttgcaaataaatcatctgaaaaaatattaaacagaagcttaggaattgtgttaactctaattggtggattaatgatttgtgtaaatatgtttaaataaaaagtaagtgagattaatgtttggaaatttttgaagcaatgaaaaaatagatataatagtatttaaatggttgtccaattatggacaaccattatattatttttatgtcatcattatttattaataatatcccaaaactctttttcagtaattatttctattcctagagttttagccttttctaacttgctctttccagcaccttctccaattacaagtatattagtttttccacttatgctagttggtgagtcagctccatatcttatagctgttgctctcatttctgctctacttttagacatatcaccagtaaagactattttctttttattaaatatatcttttattaagttttctttagcaaactcaatcatttttttctcttctgcaacttgttccttatcttttgcaaactttctaaatctatttgctattggagctgaagcttgcttagcaccattagcatcattagcactcttgctatctttgttacttttctttgcaactgaagttgatgttggtgtacctaaagctgaccatctttcaggtttaataacctttaatagttctaataaatctaaaacatcttgtaatgcattatgagcctgtccttttttaatattgtaatgctctaataaattaacaagcttatatgaaggtaatatttccttttgctttattgtattcatactacaataaaattcttgattatcttcaacccagccccaatatcttaaaaagtttctatcgaaacttgcattatgtgctactaaagggcatttatactttttaattaatgatttgaatttcgacttaagctcttcattttcttcaattgcatctaagccatcaccatatccatttttatatttttcttcatcattgataattgctaaatgaaggctatcaattactctataatcttctacaactattgcagcaacttctcttattccatcagctggactaaagcttcttggtgtttctatgtctacaattatgaatctttcttttttctgcatatctaataagtaatctgggtgtatgctatgtaattcaccatttatatctaatattatttcattattatcaactattccaacaacatcacattctacagcatcatttgtatatgctcctttataatataatgttttaacttcatttgctttaggactaattagttttaattcttttaaaacttctattttttcttctgatgattcaaattttctccactctcttttgggatttatcatacttgtacctctattctaattttataaatttatttctatattaatttaaatatattaaaaaatcattaatacttaaaagttgttatattgatagtatatagctatatttagtattctgaactacttcttgtcatctaaaggcttaatataagatattactgttttgactatatgtaattataaagttatacttaacctataagttaagcaaaacaagtttgcaagacataatatcgcggggtggagcagttggcagctcgttgggctcataacccaaaggtcgtaggttcaagtcctgcccccgcaaccaagaaaaataaatcttatattttataaggtttattttttttgcataaattaataattctttatataatcaaatttctaaaaatattttacaaaataaaaagctatagcaaaaacttaatattttcaccatagccacactatttcctttattactaatataaaacttatactctatccatcatcttctttgcttcttgcttatttgtcaccatacctaaataagtcattccataaagacctgcaaatcttttcattgtaaaatctcctgcttctaacatccacttttccggtgcagcaccttgaaaaataaaggccaatttcttgccactaagtccaccgctttctacagttccataaaaacgatcaataaaagttcttacagaaccacaaatattatgccaatataaaggtgaaccaataacaatagtttttgcttcctcaaccttagataaaatttcttcaaactgatctcctggtaaagtttgcccaaatacatttaccctataatcaggcaacattaaagtttcatactcttttccatctaacatttgtttagctaacattgctgtattaccatttttctcagaacttccattaataaataaaatatccatatttccatctccttaaattttctatttacattctaataaaatttcataaatttcatctggtgttagcttcttgcaacatccatttgttaatatagttgtatctgcaaccttacgtaatatctcatcatcttcaatattcatttccttaaaagttgtaggaagcccaatttctttaataaaatcttctagagccttaattccttgaaatgcaagttcttcctcactttttccttcactagaaatattccatacctctgtggcaaaacgagcaaacttagttacagcttccttataaatatgtttgtacataacaggatgaattacagcaagcccttctccatgattacaatttgtgtaagcccctaattgatgttcaatcatatgagcttgaaaatctgttacttttccaatcttcaaaataccattctcagccattgctgaatcccacattaactcacttcttggagttaagtcatttggattttttattacctcacggatatttctaattgtatttctcataaccgcttcattaatttcatcagataaaaaattctcctgtggctttccaaaatatgtttccatagaatgacttaaagtatcaaaagctccagagattacttgcttaagcggaacacttattgtatatgctgggtcaaggattgcaaaatctgcagatgctccccaaagacctgactttaactttttctcttcattagtaattactgctccagtattttgttctgaacctgttccagatactgttacaataacaccaaatggcaaagctttttgtggaaacttatgatctacaaactccatgttccagatatcttcctcatacattgcttgtgatgctacaatcttacaacaatcactaacagatccaccacctactgctaaaatgaaatcaacattttccttctttgcaagtgctgctccctcttgaactttctcataagttggattaggcataattccactaaactcaactactttctttccaccctcttttaataatgtaattatttcctcatagattccgttctttttaatagaacctcccccataagcaagcataactgtattaccaactttttttaattcttctggtagattcttttgtgctgctttctctccaaaatatatttttactggatatgaaaatataaattcattcatgatatctcctcctatatttttatgctacatccgatctatctatctcttgttcatgttttagtaaagtataagatacttaaacttcttttgttttacatttattccctatatttcttataataaggattatagaaaactttcctagataagtacagtgctaataacacattgtgctataacttaaacacatactgaaatataaaaaaataagctttgcattttccccggaggaaaattgcttagcctattatttttctagaaatatgtttaaaaatctgaacacttagcattttatataaaatactatacaaaaataatataaagctagaaaactaattaatgttttctagctttttaaatgtattacttatttactatttttatattaccctaataataaaattcattatataagtttacttagcttaataattaacttttattttattataaatttgcaccaaaatcagttactaatacttgacctgttattgctctagccttatcacttgctaagaaagctatagtgttagctacatcttctggttcacaaactggtaactttaaatctgcatgagccatcatagcattcatcatatccatattcatattagctaaattttctgatttatacattggcgtttttacagatccaggacacacagcattacaacgtattccttccttagccattcttaatgcaatatttttagttaatccaattattgctcctttactagcacaatatacagctcctccagaaccataaacaccagcaactgatgctacattaataattgcaccacttttattttctaacattaccttagcagctacatttgtaatgtttatagttccttttgtgttaacatctattacaaaattaacatcattttcatcaacagcctcaataggtaaaagtgcatgatctagtacaccagcattgttaactaaaacgtctaatttaccaaatgtttttattgtttcatctataacatttttacaatcttcttttttagaaatatcactagttactactaatacttctccacctaagcccctgattctttgggcaacattttctaattgttcttttcttcttgcagttattacaacctttgcaccttctttagcaaacaatagtgcagttgcttctccaattcctgagttacctcctgtaataatagctaccttgttctttaacatatgatcccctccatttacatctctttattatccttttattttaaataaaaatattatttttatagttataattttatcatcttttttactaattgtaaaaaatttcaacttaataatttcttttataaatgtgaggatatttttatttataatacatatcatataaccggattaggcattctaagctagatcttatcatctcaagagttaacataatatagttttaactatatatcattataagtttatacttaatctaaaagttaagcaaatcaaatttaaaaattctattaccttcaaattatactgctttattaaatatagatactgctatttgctgtaaccttatttccttccattcttgttttatattttttctactatatttatattctctaattatgtcagtttcctttacattatggaaactaaattgatatccgtttacctctatgtaaacaacttgtttcgtataatacatatgtactccacttatattattaattattatatcttctataacttcagatataatatttttaaaagtataactcttctttatttcttctatagcataatcttttttaacataagaatttaataaatttgcactagctaaaaatttaaaacaatctttttgattttttatgttatttcttaataatattacatttatataagctttccttacactctcttcatctattatttcttctacaattttattttcttccattatatacactcctctaatctacctattatataaataccactatctcatcttgactatatcatttttactacttcttatcctaatgcatattttacatctggataaacttcaataataccttatattttagtttctattagtcttaagtatttaatttcactatattaatttcattttttcatctatctgtattaattaaacttttaaataatcctattttatttcttatttcattacttcttatttcataatcaaccttatcattgcaaagactactatacttattataagaatataattcattaattttagttgatgacactactgtcttcttaaacattttttcacacatatttattttatctattaatacatttttctctaataataattttctacattcatcatttaactctttttcttttaatatttttgtatctaataaatttacctttaaaaatttttcataagtcatttctacatatattgtttacttgtcattccatggcttttgcattttacttaataaattatcaatattttttacattttcgatactagatgtattaatcaacacttgcataataaatagctgaagtaacccctttttatattgtactaaattatctacttgccttgttgttattaaaattaataaagaggtaataattgaactaatcaaagctcctgtattattaaaacactctactaataaatttgattttaaaacatttaaatttctaaacaaaatactaaatgcactcatatatgaagaattacctatagaattaatagttgcagattatgcaacctcaactatattatgtaaactttgtttaaatactttatctgtaaaaggcttgtctaagttaatattgcttaattttagtaacttataatacatttctagtcttagttgctcatcaggaacattagaatattttaatgcctgttcgttgatgtattcagtaattttatcattatcacttattacaaaaaattccttggccttattaaataaaattgcaaataaatttattttatttaatataacataaactattctaagttgataatctgatattccaagaaatcctttataaaaatataaatacttacaataagcaatcttttaatacatttgaccccctaaataaaatcttactgcaaataaaatcctatataatatatgttattttattactcatatgcagtagttgttatgcttattcgtacttataagtaatcataggtattaatactattttctttataaagtaactaaacttcttttaaattaaaatacaaagaactctactttataatttttagtaaagttctttatattatttaatatgttgtttcaaattaaacattcttttaagtatcatatcgatttattttttatttaacaccttttaatacaattccttctttaaatccaccacgctcttttaacttttcttcccttttattaagtaaatcctcttcactatatccaagattagccgctagtccaaataaaacttccataacgtctgcaagttcttctaagtttttatcttctaaatattcattaacctcttccataagtttagcttcaagaagttctgctcttttttcttttggagctatttctatttcacattcttttcctgattgtcttattacttgtggtattaaatctcttactaatttattataagttttcataattgcttaactctccttaacacaaattgcatttaaccaagtgatatctcctcttcctggaacaatatcaatggttttataaactttcataatctttaaaccttcaactttatttattaattcattaaaagtttcttcagtatagcaattaaaatatcttcctttttcatctatatattcatctgcaccatacttaaatgacatataaaagattccattatcatttaaatttgatgatacattttttataacatctaggatatctcttttattaacatgaagtaatgatgcacatgcccatattccatggaagttgtctattaatgataactcttcaaagttactaactaaaacatcttgacctattagttttgatgcactttgtgctaattctttggaaccatctactgctgttattttgtatcctttatctataaaggctttactatctctaccacttccacaccctaagtctaggatagttccaccttttgggatattgtttaaaaattctttatataaattgctcatatcaattgtaagtgttgtttctatgtatgtttttgaattgttgttgtaaaaatctaatgtgttatttttcaatgttgctacttccttctagataaattaaaagaagtcacaataaatgacttcttttaattcctattatatactatttttctttattaaaaaatctattcttataataagtttcaactctaagatcaatagcatccttcatatgcttcttaaaatcttcattacctataatatccttaagatcatcataaagagccatcaagcatccatctttctctttaaagaaatcaccatgagttttaatcaaaaacttaataggattatttttagctaagctaatatacttcttcttgtcccaattcataaaatcactagtacttttatccttaagcatatcaaccttattagatcctcttctataaaactcataaaaacttttataaatatcatcctctgatatctccatctttatatctccatcattataaaaagctaataaaactggcatcttataagttttactcatacttgtagtttcaatcatattaataaattctctacctctagaattatatactatctcttcatcacaacttaattcatcattatcttttatatactctaaataattcttaaatgggtccatagatttatttttactcttaatattttgataaacttcatcatccatataagtaaataactcaactctacttggtctatgacctaacatatcagatacaatatcaaattgctctttgattttatccctaaccttcatttctctttctgcttgctttttgaatatatcaataattctaaaatcaaaatctactgtacattcttcaggaaattcataatcgccttgcttattattcttactttctacagctgaatattcttttccacttaataaaaatggcactaaattagcctttttataattacctataaagtctaaaacatttaaatatttcttatccttagcctttcttaatcctcttccaagctgttgcaagaaaattgttggtgattgcgttggtcttaaaaacataaccatatcaattccaggtacatctaatccttcgttaaacatgtctactgagaatattacctttaattcaccggaagtcaatttagctaaagctatatctctttcctctgaatattctcctttttctccactatatacagctactgcaggcactttattttcattaaatacctttgccatatattctgcatgatgtcttgaactacaaaatcccattgccctttgtgaattatatttttgataatgattaaaaataagttctccccttttattaagcatcaatgcttcttcaagttgtttatcatcatatttaccatatttataatctatatcttcataattaactgtttcatcataaatgccatagtatttaaaaggtactagccaatccttatttattgcatcttttaacctaacttcataaaccatgttataatcacaaagtgcaaatacatctttagaatcaagtctttctggagttgcagtaagtcctaataaaaactttggtgtaaagtaattaattattttattgtaattgttagaaactgcatgatggaattcatcaactactatatagtcaaaatagtctcttgcaaaatatttttcatttaaatattcatccttacctaaagtttgaactaatgcaaatataaatgaattgtttgtatctttttgattagcgtaaaagaatccaatatcatcagaatttctaacatttttaaagctttgagctgcttgctttattatttcttctctatgtgctacaaataaaactctctcatattttgcagaatcaaatgcagccagataggtctttcctatacctgtcgctgcaactactaatcctttatcaaatccttcttctctagatttatctaagctatataatgcttcaatttgagctcctcttggttcaaatatatttacaactttctcttctttactttcttctttttctaaatccttatatatattaggccttgtccattgttttgaataatcttttaatacttcatcagttattactaatgaatggttattaaataaatcttcaaaggtatcgtaaaatactttaaagtcatttggagcatttgattttaggaatctgtagttccactctattgatgatgttaatgctcctcttgatatgtttgatgaacctatgtatatttctgaatctagtggattatgaaacatatatgcttttggatggaatgatttgttgggattattgtaaaatcttaagtctactttatctcctagttctgattttagtaaatatagtgcttgtggttgtgttatttttaaatagtttcctgtaaggattcttatgttaactccacgatttagtgcttcttttaggtcttgtagtaatagttttactcctgattccattaggaatgaaactattatgtctattgttgttgctgttttgaagctttgttttagttttgggtaaaggtggtctttatctcctgttgatgtatttgaatttatttgatcttcgtgtattggtttttcatttatttgtgatatattaattgtttcgcttatattatttatcatctgctctcctaatatttttatataataaaagcaaaaagaaccttgtaataatattatttttgctcttattaattatctcatatttatttattttttccaaatatattatatattttttaagtttatattatttatatattccaacacattatccaaataattctgagcaataatattagaattctccatatgtattgtaatataaaaatttgttgtaaaattattatcttgatttctaaacaaatatttatctagagcttttaattcatttattaaataatgatttttttcactcatccatttacacataaaattgcattgagccttacattctacaatatcattagctttattaattatttttaatcttaattcatcttggctacaattcagttcacaatcaactccacaacatttacttggcttattcatagccatcaaattttgagtatttaaaaataaatggatttcacagttttctataaaaaattccttatctagatacgttctaatttcaccttcagatacactataactataagtactttttatattacaagcatctatagccgcatgcgaaatccaatggaattgtgatatcttactcatttgctctatatttaatttcattatattaatacttactctctcttttgacatatccattaaatctgctaatctaagtagtatcattaaaaactttacatttacagcttctctctccccattcgaccttaatccataaacatcaggctcataaaatccatgtgcttcagatacctttgctacaatatcttttatcgtaggctcaatataatctaaatcattagtatctcttataaaatttgaactctgttgtgtgtgcttagatctaactatattttcaaagtattcatccattttcttatatgaattaactaacatctgcataatcatattatttttttgggaaaaattattacatttttctacttttctataatttactctccattcattcaaaataacttttgcatcattttcatctgacaaaaactgattcaaatctggttgtataatcatagagatatcatggaagtaacatgctagaaataaaacataataatctatcgattttatcttaaaaaagtctatagccttacatattgaaatacaagaacgtattaactctacagagtgttcttgattatgcaaagtataaaaatataaatgctttgaaccatttttccatacgctcattatatacttgtgcgtattgataagttgatctatataatctggattttttacgtatgttataaaaatatctaatacctcaataattgaatagtctatcttttcttgcaagtgatctttttttgcttgcttcactacatctttaacaaaatttaatatactttccactgtagaattggaatttcttatataaactagtattcttaattcataatattctaaagttctaccattttttttagtaattacaaatttatcgttaatatcaacactaaatagttttgaacacacacaattaagaatttctcttttcatatcattagagtttgtaattatgaactccatgtactcttcaaaattatatcccaaaaataaaatgtttttttctagttcttctcttataatacctttttcttttattttgttgtaatctgctataagtttattcataattctaaaactatcttgtttattaaaagtcctagctctatcaatatattcacacggcaaatttttaatcgttttatacttgtcaacttcttgattaatcaataattgttgcttaagtattgttgaaaaatacaaattgtttttacctatcttttttgttattttttcttcaaaagcacttattatagatataatcttttcttgttcaattttactgtttgaatattttaaaaataaagaagcctctgctaaaaatatatcttcctcaaactctctaaatatattttcataatcatcttctaaatattcaattgccttcattttgtatttttcataatacttttcaacctcttcaaattcaaaatctgctttaataaatcttaacatcttcaatctatatttaaaaaactttttatatctaaaaagtaacttcaaataagcttcttttgactcatcttccttttcaccctcaacttttatcttctgttttactaattctatttctttatttatagaatttaaatataattctactttatctttaatagtttcatcttgtaattcatctactgctgtagcgatatcaaaagctactgtagatactccaaatattatttctcttaaaaaacttcttccatacttctctgtatgctgtatatctgttgatatacttttttcatcttcatgaaattttattttatatgtcaactctttaagctcatagcacttttcaccaagattattatttatgtattcattaaccaaattatttatttcttttattttttctttaaagtttgataagcttgcattctcattatttgtatatattacagagtcatcaacataataataagcatcacctggaaaaactttatttactatctttgcaatttcactcatgcatatgtttccaaaataataagactgtggtaatccttgaggaattcccatagatgggttgtacatttttttgcttttactcttaatactctcatagttttcaccataatactcctcataccactctgaaatattttctacgttaaaaattagtattttttttaaaatacgctttaacatctcctcatcgttttggaatactacttttaatctgtttagtaagatattatatataaaattaggatctactgtagggaaaaaattttgtaaatctaaacacacctcatatttaaacttacctgttttttcacataaattataggtatcaataacacctttgctatattccttatacttctccttccaaggataaaaaatattttttacatctatagatggtatattcccataaaaattagatggtattaattcacttacatctgacagctctctcttaccactcttatcatcaaatactattacatttaataatgatactatacaaatttgcgttattaaatcggctgtatgtattggtctaaaaatgacttttttgtctttgtgttttttcatcttaaaaaatacttttatatcaaataaactattatcatcttttaaaatttgtattaattttttttcacattcctctataacatcacttattgtttcaaaatcatatttatcttgtaatttataatataactctaaatcatttttatctaacaaccctttctcaaaaatatatgaatttaacccatatattgcattataaatattttgttttgaaatcacctgattatataattttgattctactttattattcattattattttacctctcatacgccgaacattctttaatgaaaatgtcaatctcttcacttaatatttctatatctttagtccctaacttcctatttatgatataaacaaaattatcttctttgtaaaaaatcctcaaatgtatttttttttcatctatattgtaaatatccaaaggttctatataactatttatatccttttttattttttgtaagatatttacccctttactatcagttgatatcatactgcacaattcattataactgataacattagttccatacataggtaatataatataataattatctgccaaaataaaaaaattcgtattattattctcttttaatttatcaccaattttacaacattcattttttttattttttaatacttctaatttcttaatgaactttggaattaaatctgtaatgtaagttttattatataaataatctgaattgctagataaaaacaaattaaataattttattatcttatcatcaacttctttcttctctaccccataatcaattaaaaatgactcacttgctatagcatcgaaacctttcatcacatcataccctttctattcttttctaaatatattttttcgattttttcattattaagattatttccttacagaatttcttctttaatatattttaaacctaaataatctactaattttcttaaatatcttttatcattataaatttatactactattataattgattaatatacatgtttatgtcgaaactagtcataaacatgtaagttaatttatataaaataaaaattacctatctaaataagtacttttatactctacctattcaaattagaccctttttactttaacatttcatctaatataatttatttctccactattcaaaaactttactaaaatacactctacacattatgttacataatacttattataactttatatttaagaaaccttgtcttgataattatctacatctatagtttcttttttagcaactttcttctttttcatattaacatagttgttacatttatttgttcatttaaatctataactaataccatataacttgaactagccctactgtagttatgcaatttatccctttacttgcatattagatttctataaagttatataactatctttttaagtactttctactaaatgaacctatatttatactaaaacttaaatataacataactttataataaagtaaaaacagctacaaaatgattgcaactgcttttactttattttacatctaaaaattaatttaatatttcactacccaaacataagcttccccaaaagccaaattcgtagcttctcaaagtaatgtataagatatactatcgatatcatatgtaaaaacatatactatatatcccctatgtgtttttacattttaaccattgaatttatttgatttttttgtggatattctctatgattttgttatttattatttttaattctgtattaagttataacagtattataagtattcaatattagtacttttttacacaaatatcatcaatattatatctatctaatctatatctcttataaacactttcatacattgttacaatactttcactctcactacttaccgtctttcttagaattccatatgtataatttattattttttcaatttctttatcaactcttctattttctatttgatataatgtaatcgctaatgcttttattgtttcttcaaccccatactcttcttccattagttcaatagcttcatataatcttgttgaaccttcaacttctggtaaatttttaaccaaaaatctcatactcttacttatatctgaaataccattatcaaaactaactgctccatcaataactatttcattaatagtaagtagttcaaaacaatcttcacataatacaacaatttcattcaaatctaaagtgttcttatttgatgtaagataagctatctttaatcttcttccacactctccacaagtgctacatgcaaaattttgcctagccattgctagaaatcttaattgcggattaacatcctgaacataatttaaactttttatctcatttgattttctacatataaactttggaactattattatattatcttcctcgttaacagctattacattttttttcatcaaacttcttaatattgttcttacatcaattattcctgttatatctattaattcacctactaatggataatcaaaattcactgatatgtattgtcctactaattttaactcagccccctttgaattagcaatctcaattaatttaattagcatatttatctctagccttgtacatcctttaattatgtcttttaatatctcataatctcttatgatttcattattccagcagtttgaatcttcccaaaatttaattctatttaaaaactcatttttatatataatttctacttctttaaaattaatttcatgtagctgtttactttttagtgaatctttaattattctttcttctcttgccttaatggcaagcatcattgctgcccttttctcccacagtttatattgttggataaccctcttgtaatctgactccatataatcacatttttcacataatattttataactatatcttttcatatccttcattattattaatgaacattgacactttggacatttaacattatctatctgtgagtaaataccttcaatatatagttcaaactcctgttcctttattctaagtatctctagtttttcatttttttcttcttcattcaataatgcttccgttatttttttacaattatcacatgtatacctcacattatctcttaacatgtctattgaaaatttattctttaaacattttggacaactttcttctaattctatcactggatatattaataactctttaattctatttattggaatattatattttaatgaaacctcttctaatcttactctctctaaatatatttcctttaaaaactgaatataaagctcacttggataagactttataatatcaacaaaggctatattattaggaatgcctaattcttcttttatctttttaataccatacgatggttcatgccaaaacatttctgaaaataaaattaaaccctcatcaccatttttagttaaataatttttaatatattctacttctaaaaaatcatttttataagataaaaaatatttattaatatctattttcttaaaatattcactactcttcatttcctaaacctcttcataaaactttataagctttctttattattcaacctcttatatctctcaattgaattctcattttcattctcaatctcctcacgtaattctttcataatgcctatataactatacatttgtttaaatagaatcatagattcatttattgcttctttcgtacttaacttattattaatatattgcaaatatatatatgataattctacaaacaaatcttcaagttcatcaaacaaattaaacttcacctttaaaacacttgatttattctccttatccataaatcgaatattagtaaatcttattattttattcataacttcatatccactagccataatattttcatcaattgaataccccttactttttgtgctttctattttattgattataatatctataagaattaatgcttcatcactagtataaattttagcctttggatagaaatcattaattgcaacgattttatctcttataagacttacagttataacttctccatatctaaaacaatagatttttttatttaatgccttaagaattttattacttaaagtttcattattaatatcacctaattctattggatcatttttctttttctcataaactctatttacaatatcaatgatttcgctttcttttaaatctatataataatcaactgaacattttgacaaatcactttccatatcactagtaaagaaatgaaaacacattttatcatcgttatctaatattgctgcaacactattacctaagtatctaacctttttactttcaataaattctctattattaaaattatcttttccaattatccctttttcttttaaataccttcttgttattacatcatctataccaatataacaaattccatcaatatttaatgggcttaatgcattataaattaaagagcagcattctataaaatggaccctatatagtagacactcaaaaaaagagtatctatctatatagagttcgaaccctcctttttttatcggctattatcaaaatttattttgatacagcccctttttattcttgaatagctgctttaacacaaatttgtatagcatcaatcctcttattaagtataaatacatcctcaaatgattcttcaaaataaacatatttaccttgagacatggcacttggagattctaattgtgcaaactcatatgatactatcggtaaaatcgatgatggatgtactaataacatcttaatatctaatgctccagttgctaccttatatccattatcaaaagtatattttgttttaaataaatctgtaggaactgatactatatttacttcttcaagtctttcaacatctcttactatcttcttatctgcattgcttcttactatagctattgccttatcaattaaagttttagtataagtatcacaatataatattcttcctgctttaggaacccttgcttcatccatagaatccatcatatcgtcaaacttatctaaaacattagctaatgttaaatcactctctaatggagtaatttccttttgtccatttcttaactggtatatagttgagaagatatatgcatccatttctgggaacttttcttcttcattcattaccttagtaatattagctatagatacaaccttattagtttcatctatatccttaggatgtgctaatgtttgccatatcctatgattttttaatgttttagtttcccaagcattatcaaaatttcttgtaaaccctccaatagtatctctattaccatttgttctaccacctacactaattgatggtatttgtattgttttagcatctactactctatacttgctagagttttcagtattccataatgctccactataaagtacatatggataagcttgtgctaattcttgtgcgtattcttgtgcgtaatttaatgctgtcatataatattctccttctttcttttattattttttacttcttacacctgtaaagttaaagccaaatgattgattattattactttgaccaccctttggaatgtttccacctcttaatttttcatttacagctctctctactacagtttggaaagctttttctacagcttcaatacttttattgcattgctctgcatctgaataattaagaatatctactaattctttaggtaaattcttttcagctaaaatttcatgcgctgttgctctaagctctctaacagttatgtctttttctcttttttctagctctgcatttcttttttcttcttcatactttgctttttgttctgcattcattttagctattttttcagcttcagttctttcatcctgaactcttttttcccatttagattgctctcttgctaatctatcttgaattagcttatcaacatccttttgagtaaaagttttttcagtttgatttgtttcattttgttcattagaattagattcattttgatttgtagtatcagaattactattattacctgcaccattaactcctgatcctgtatctgcttctaacatcctttgaatttttataaacataaaatccctccatttaacgtccgtatgactaaattccatgcacagttttaagccttaagcaagttttgggcataataaaaagccttagttttctaagacttaattattctttcaactttataattttcccatttcttataagcatctacatacatttcttttttatctccattgtatgtacactcataatacattccatcaaacaaagtagtgctaagtaatgctttattattttgcagtgttttacagcaccataccataaatacatcatctgttgtaatttcctttttgtctgctttatctagatgtttatttgtataatcacatacttcttgtttacaccattttaaaaattctttttcattcattatttacgcacctccaattctatattttctatttctgctctttcttctaaatattgagcatacatttccattgattttaattgaccatttaataaatcataactacaagatggtttaaatgttaaatcacctactttgtatttcttaagcatatttcttaatccatttattcttatttttaattgtaaatactctgctttaaatctctctttatagtctgcactcaccatcatttcaatagtatcttttaattccatactttcagcccctccttaattttaagcataataaaagcacctactatttaatttagtaagtgcttactacattgaatataatccaatgtcttcccatatatcttttaataatttatcatttattttatggttattaaccatatctaatccatttttataatatactgcatctccattagggcattcacaaataaaatattcatcatctccaggagatatattatatctagttccgtaaagataaaattctatatctaaccctaaattaattgaatctatcagttcatttaaactattaaacttttctaaatccatattaatctcctttcaaaatatccttattagcaatcatttgagccttagtcaatggcaaatctttaggtctttttatatcgtcatgattatcttcattttttaaccaattatgttgatgaggtactgttctatgttgtgctggatttccatgatcagttaaatcaatatccaatcgtggctttccagtattaccataatatcttctagactctaattctccatttttataattatcaaaaacactattaggtttagcattaaaaggtaccttatgttcactacccctaataatattctcttgcgatttaatttgccaattaacatctttatataatgtttttaaatcttcatactctttagtattattatacttcattttcctaaattcttcaaaagattttggaacttgatctcctaatatttctcgatattttttatatgttcttttatcactagattcatttttaacttttttctctagttcttttgctttatcttccccatacttatctactacatatttatcataccattctttataagttatatcccctttaataacattgttttcaccagtaactacatccttagttctaacaccaattctttgagctactccaccatctattatagggcctatagaacttctacaccatggatgcattggtggaagattttctcctgcttgtgcatctttaatatcaaatattttaccatctagctctctacaaatattacttacttttaaatctaatttagcaaaatatctatacttttctattccacattccttataaccttctattgcagccatattagtataataagccgattcagttcttactaatcttctagctgcactttcaccaacttccattttttcagttaattcatctatcattttctttaatggcttaccatttaataatccagataatacagtttcataaagctgatctgttaactttgatgtattcccccatattcttttagaatagtttccccctgcaaatggtctttttaatatagactcaatagtttcttttcctaaagctcctacatcaaatcctatttgcatacctctttgaacttcccacatatgggtataatatgattcattcatattttgaataaataagtttttgtctactaccatttcattaatagcaactgcattcattatctgctttaaattatctactaatgtttccttaagaacctcttttcttgctattcttgctgcataagctggtgcatctaatttagctgttaaaaactttcttaacttatcatcctttgtatttagaattaatttcttcaattgctttctatctaagtttgataattcaatatttaaaaattcttttacttgcttatcattaagttcaccatttttcttaagcttattatatatctttctaacatctacttctatttcagctatagcctttatataagcacgccttaattctctaaatgctttatctgcatttaattgttgtgtatccattatggcatttgttctagcttcccaataactattatttctactattcatactataaccttaaaacataaatagatagtgtccaatttgctatagtgattaaacaaaccacgaaactacttattctatgaattttagtttcaccatcaaatacattcggaattatttttaatgtaaataaaatattaaaaaataatactatccaagcaattattttcattcttctataccttcctcaacgttattattaggcttgtctgtttcatcgtatgggaatccaaaggcttcttgttgttctttaatattctgctttttctcttctaataatctttttctttcttcttcaatatcaatttcctcatcaaacctcttaagtctagtttcccaagatataaagccctctgtttcttgtgcaattctagcaagtaattcatcatcaacaggtagtgatcttttcataataatatctatttgacttgaatctatatttttagcctttatattttcaatattagaaataagctttaatctctttcttaatccttgcttaaagtatctctctttagtttttcctaactgttcaaagcctaataatttgtacttcatagcaacaccagaagcattaccaacaaagttttcatctgttaaacaaggcactttagaaaactcatgtatatcatctttaaggcttttcttaagaacttctatttctgtttcattaaggtttttaaccagccatttagcatccccaccttggtctagttcaataatctttaattcttttagtaacttagctgtttctaccttttcatcaatatcatcacctaatgaagcacctataacagcaagaatagcatctacaacttgctctttatcatttaccctatcagattgaagtaaattataagcatctattaaagttattattccttcaaaatctcccttaaaatttttattatttttatattctattaatggaatatcattaaaataatgctcctccaagtcattaatatcaggtgattcatcagttaaatttgtaaaagaataataagttatacaattatctgtataaacattaacgtcatatccttttaaagtattatctatatcaaatttaggaaaataagtaactccaaatataggtttatgtttaactgtactatctacaactataaatgaatttaaaggacttactactgctaactctgggtaaggaacttcttctttattcatataaagcaattcatatcctacaccgtatatagataaatctaaagccagttcattattatgactatcttcatctatttctataaatatattatttaattcttctgaaccatctccactataacttactggagaaccaaaaacatatcctgttgccatatctgtaatatattctgcatgattagcaactattttattattaggtaaagactctgtagataatatcctgtttaaaattttatgatttccgtcataatattcttgaagtagtttgtattttttatttactatagttctatgctctgatatacatttaactaatagttttattggaatacttccatcttcatttaataaatctctatccttaattattggcatttcctcacctctcttttattatttttatattatcttaatcctaacttaaccttactcttaactttaattttagttgaattaatttcatcttccattccatatctacaagcatctatagtgtggttatttttatcaggatattctccctttaaattaccatctttatctttttctatttcataacctacaaactctctttttgcattaggacatcttactggatcaattattatttcttctaattcttcagacaaaaatttaagaccatgttcaactgaatctggccctttctttgctcctactatatttaaccctaaatttttaaattcatttattgttcgaggttctgcactatctgctgtaactcttttatttaatttattaagcttctttatttcttcaactgctttactattgcttaactgaaccttataaacttcaccaaatatatatagcttctttctagtcttatcataattcattaataaataagctaaaggatcagctgcataaccaaagtccaatccattctttaatctatcaaatacttttatttcatcatctgttatttctcttactgttatatttctaaatacttctccaccagtaccagtaacagcccctaaatagtcatgttcatatttagttggattaactttcttcatatgttcagcttctataataaattgctctccaagccattcttttggtactgttctataatcactatggtgtatatatttatcttctctagtttctacaacttcttgattacaccaatttctttgactttctggtggattaaaagaataaaatacaataaatttaggaccacccctcatcaaagattgattaatagtatctattttatgttttccttcaaattcatctacttcctcataccaaatatatttaatatatcctttaggtactttagtagatttaactttcttagggttatctgcacctttaaatcttattacttgccctgtaggtttatatgtaatagttaatttagcttctggaacatgccaatcatcacttacacctaaagtatctatggcccattttatttggtctcttactgattctgataaagtatctttaactcttcttagtattaaagcatttgatattataccttcttgtgcatctctcatcatacctaatactatttctatggatataaaagatgattttgtacttcctctgccacctttaaaccagtaatgagtatgaagttcattctttatatccttatgagaatcataaaagctacttgcaattatactttttaactttactttaaccatctatatcatctacaatttgaactctattattaatccctaaagtatcatctttatttagtttttcttttaatacttctatccttaatttttgttcttctgttactagatcccaattcttattaaccatttcatcatactgctttatcatattaaataaagtttgcatagcttttgatagtgttgttactgctgcattctctttatcccaagcaaattgatattgccattcttctgtagatgagttttccccatatgcttctttggttttcacctttgtaatatcatttttattttttacattgataatcttttgcatatttaatattttagcctgttgtattaatatattgctccacagcatatctaatggattttcactcttaagctcttctattacattcaccatacttctaggtaaatatttagataaaaacttattatctctaaatcttgattcatcacaatatataccatgtttaagttgtcctatatttcctaatgcatttttattgccttttggtgctccacctttattaatccatttatcttctcttctccacagttttatattgctttctttttcatttagttgttctgctatagctttacaagttagctttcctttagaatgtttaaataactcataagctaaatctctattaggatttctttttctagccattacacacctccattactatcctttaatacctttaaagcaagttcttataacacgtgaatactgtttaggttgagtttccagatttataattaactctttttgattttaaaattttaattattattgataaaaaactatttaaagcctttaaaatcaatactttgaaccccattactcttatcacttccttatgcgaaataacccctatgattggagatatacttttttaagtgcatatattagtagtaatttttattttttctttcttatatgcatccgttactttttttcgtattaagtacaaaaaaattataattttgaatctgctattcttgatgcatcttctttaatttcattatctaatcctaagtaatgttttgtagtttctattgacttatgtcctaaactttttctaacaaactctaaatctcttttttcttgccataacctttgagcatatgtttttcttaaactatgtccagtaatatgttttaatcctaattcttctccaaccttttttaatattgcactatatgttttaggagttataggctcaccaaggtacttttcactttcaaatgcatattcactattttttttacctttaacatactctttaactttctttctaagattcatttgaattattgactctctaggagctggtggctttctttttgaattaggattatttgcaatatgtgttttccatgcattatattgtttactttcttgaataataaatttatcttcatccaaaaactcttttaactctccatttgttaggcttaaatagtcaactaacctgtatccagttgcaacaccaatataaaagatcattaaatttctttcaggacaatctttacttatttcctctaacttatatttgaatctattataatcacgctcttgaatgggaagtgccggtactttctttttcctttcaggttcttcaactatttttttcttttttctagccattttatctcacctgctttatagctccactggcacttcttctatatgagctatgactcataagttcttttatttctctttctgaaagatttcctactgtttttctcctaataacattaagcttatcataagtttttaaattgctttctctaataagttcagctatgttcattgaatcccccctaaaaagaaaagagcacttagcgatttgctaagtactctttaaatttttccacaatactatattaccatattttctcggtaatttttcggtaattttcgggtaattttttctactatttttaaagatattgggtaattttatggtaatttttttattgttttttagattttggggtaattatgcacttactctttgctcttcttcatctactgaatatatagaattataaatttcctcttctcctttttttaataaattttcaactgtttttcttgttctatcaagctttttacaagtctgtgtcttactcatcttatttatgtataaacattgaattgcttccttagctttttcattcttaataagtttaatccaattatcaactctattatttatagtctcatagtattcaatagtatttattaatctttcctttctatataataattcatcattatttttacattttcctgaagattgtgttttttcttcatagctttgcgcttttaaattttctcctaactctagctcttttaattctaacttcatatcctcaatcttaatttttcttattggatataattctagtttttctctaatattaactaatctcttttctattaatgtttctttcataaataattcatcccctcaattttatttaattaaatatatttttttacattaaaaggtgttcattatgaacaccttttaatatcaaatatattctattttaaataaatgatatataatcatttttatcctcttttattaatttagactctatttttacatctatttttttaccagtcttaaggaatgcatcataattatcacttgctacagaaaatgactttatttttacataattaatttctttagtcaatggaactgaaattttatgaaaatcactgcttccgcctaaactctttactccatttatataatctatacttatttctaaatatggaggtaatctgagctctaaggtaacactatgctgttcattaaccctatccaacgacaagttagcacttataattacaattgccccctccttatttatatatatattttcttcaaaatcactttctaattcaatattttctcctattatatgcaaattaacattatctaattttcctagtaattttttattatatgaaaataatcctataataagaattaaaactattattatcaaagttaaaatacaccataacaactggttacttgtacaaaaaactgcacctattagtgatacaatcgatgcaatacccgaaataactacaaacgccttactcttacttaaccattctaatatatcatacataataatatcccttaatctactttcattattgcatggtttattatttctataatttcataaacctcatgcctctgtgcttttggtagtatcttcacaatacccctactgttaattttaacatttaaattatggttaaaataaaatgcaagttttacttcagttattcgctcttcatctctatcatatttaccgtttttacttatattaatattattaaatccaatatttacagtttttccaattacgttattatgataattatttattatatattcaaaaaaatcattttctaaattaattcttttaaaattagaatatttgaatattgcattcaatactaatgcagctttcttcaaatttgttctctgtaagaacataaatacattttcactattaggtgcaaattgccacaaagtaagtttacactgtttaacagattttatatcactacttactatcttatcattttcaaaatcataaaaagcaatatcctcttccacctcattccaagtaattgagctttctattaaagaatattcatcatttatatcaattttaaaattattaaataaagttccctccctagtaaatgtaagtgattctaatttaccaattctttgagattcgaaaatcaaactctcacgacactttaaaattaccattgaactaaaatcattttcaagcataatttattccctccttataattttataatagtaagaattggcttttaattcaacatttttttatactctgcattattatattttcaaagatcactttttatattataaatacttaccttgaattaatcttcttgtttgctcttaataaacaactccctacacttttcacaatttacatcgcttaagcctttccattggatatttttaaataagttccttatacttaatgaatgttttccgtattcccatttttcaccacataaacaagtaaaggcaccatctattatatgtcttatattgccctttactgttgtcggtaaatcattatatcttctttctaaatctttcacataaaccacctctaattagatatttacttaactgttgtattttcaaaatcatcaatagcttctacaacattaattccattaaaataatatttaacagctcttttaataactgcattagttaacttctctttatcaatcatacttgcttaccctcttttagtaatttctaatataattcctggaccatatccctttagatatcttgtcccattatcataagttgctgataaatgtacttgagctttaacgtactcatttttacttatctgcattgatcttactccttctctcctagttatttctgctattaattcatctatacttgcttctcttaaattactcaccctaattgcctcctatctagtgatgtaaatctttgatagttcccaaaccatcctagttttaatgtctttacttcaccatttctatttttaccaactataacttcagctatatttctatcttctgattctttgttataatactcatctctataaagcattaatataatatctgcatcctgttctattgaacctgattctcttaaatcagatagtataggtcttctatctgcccttgcttctggtgctcttgataactgtgataatgcaataattgttatatctaactttttagccagcttcttaagttctcttgatatctttgctatttcctgctctctagaataagatttttcagtactctcaatcagttgtaaataatctattataactacatcaagaccctttttaatctttaaattcctacacttagccttaatatctgctaatgatgttgctttatcatcaataaatatttttctattgcttaaatcacttgctgcattagctatttttaaaaactctttatcacttagtttcccgattttaatagcactaaaatcaactaagcactttgcagctaacaatctttccattaattgatcccttgtcatttctagtgaaaatatagcaacactgctttctcttgatgcatattgccctatattaagtgcaaatgctgtttttcccattgatggtctagctgcagttattataaaatcacctttttgtaaccctgatattgttttatccaattcttcatatcctgtagaaactcctaagatttttcctccattttgataattatgttcaattcttgataatacatcggtaatagcttgatttatatcgactatttcacttgcatctttagaattagacaccttgtacacattatcttcaacaaatcctattaaattatctaaagcttcaccatcataacatctaccaacaagctctcttcctgtctttattaaatttcttctatcagatttttctttgattatttttatatatccttcaacgttagctccataaaatccactacctgcaatatcacttatataagaaattccaccacaactttttacatctccattatttttaatttcttcaagcaatagaacaagatccacttcgctatcccttctagataactctttaatatttctataaattctcttatgcctatcccagtaaaaatcatctatacctaaaacatcttcaacctcttttatcttacttggaacatttatcatacttgaaagtaatgcttgttcagcttctaagctacttggtaattcctttaacacttcttctctcatagttacatatcctcacttaagttaaatatatatttattttcctgtacttcattattgcaagtattatctttaatctcttctttaacctctatcacatcatctaggtaatcttcatatcttccattaaagaatgttgatccattaagtataaactgtttatcttttccttgaacttcatccaaatactttttaatacatccaacaagtacatcttttcctaaagtctctagtaacttaggtatttttttcatagcttgagctttgcctttcttgttaggatataacctccaaatatcttgtgcatcatttgcactatatatattatggtagatggatatagtagatggatttttcattccgggtttcaatccgtttgattcggatttaaatccgttaccttcggattgtgctccgacctgttcggatttaaatccgaactctttagattcacttatacctttgtcattttctggttcttttttaggatttttatcttctttgagttcatcagaaattaattctatatatctatctccaactgcataaaagctccatacaccaccctgttttaaagtcctatgctttagtattcctttatcagacatagcctttaaacgtctgtaaacagtatcctttttaaatttgaaaataggatattcttcaattacagcatcatatttaacccagtaaaagatttcgccatcaaatacctttttagtgattttattactatctttaaagtcaataaaccaccttaagatagctaaatctttatcatctaacccaatatctattgcaactctttgactaaaacctaaatgtgtaaatttcatccttatgctcccctcttattccatgacttaaaccatagatatatttcatcattaaccttccatgagttctgtggctttaattttccatctttataatcaatccaatccacatttctagtatagaaaaaatctatatttatctttatttctccattttccatctttataactaaagttgtatctaatatttctacttttttagtagttaatattccatgaaagtcatctctgttaaatacaacctttggtgcaggatcatcgcctaagcaacttaatattttatttttcttatattcataccactcttctaacgttttattttctgctgtcatttcatctagtaatactttatcttcagctttttctacaggctgttttattccttgaattaaaatattaatttcctgcttatcttccttagggtccaaatcctttacctgcgtataaatttcagcttgttcatctttgcttaatccacttaaaactacagcatcagttaatgtaatatctccttcatcaactagtggtttaaaatcatctataagtcctttagaaaccttcatataccttccaacttgtacacctgaaagaccaatatctttgccaatcaaatctcttgttctacctttaagagtttcaccattttttcttttttcttcatagatttcctttaatctattgataccttccattttttcagtatgtgttaactctctttgcctagcattagcttgaataagtaaaagctctgaatctaaatcgcttaattccttaacttgacaaggaacctttttatatccaagcatttttaaagcactatatcttctttcaccagataatatctcaaagttaccgtcttctctttttctaactacaagattatgcattaatccactttctttaatagattctgctaattcttcaacttctctaattacatagaaattcttattagatggcactaatttatctatatctaaatctataactttaaacttatcctccatatttacatatactcctttatgttatataatggagttacggatggcagtccgtaactcaaaaagtgtttgaagaatccttttataagggttcttttttacattaaagcaattaatttcttttctgctgcattaaatacttttaaaatatccttttcactttcataacctgcatatatatcaaataaagttactttattactttcaccatatttataaccatctttgttataatgaattaccatatgatttacatgtcctgaaaatgttataaatacatcatgctctgtataagtattaaccttcatagctaattctgacaaatgtaaaaatcgactcataactttgttactcattttatcctccttaaaatatctatttcttattttcctccattgctaaaacctcatccccatgctctataagtgcttcaatttcttgaggttttaaaatactataggtatattcaaccataaagtccaaaagcttgtccttaacctctgtaaggtcttctgggtaattaactactactgtcatataaatacctcatcctccaaaatatcatattaatatatgatttatttatcctctttgttacttctaattctttctatctttcttctataaaatctagctgctaactctaatctcttaagtaattccacttcataatcaagctgattattattaagtttttcaagtaagctttgctctgtaaacaattttcctataggacaactacaacaataattctctaacaaataacttgcattataagctttggccataagtacaactctatctgctggaacacttttacataaatccaattcatacgatattaaagaatccataggaatatttaactcatatgctgtactttctcttgattgaaaaaccggattactttcagcagcttttaatcttgccttacagtaaatattattaatagccttatatggcaatcttcccatttcaatccctccatttatttttcttaaactccttaaatccttcccatgtaggtataattccatttggcttacattcttcttctacatacacaatcaatgcataaattgtcattatactccttctcctttttgtactttttaccatttatacatattcaaaatatagttataatcatatgtgatttaaaatcacatatactacaaaaaaatttttattatttcgttatcactaatatttaaaaattctttaagtatttttacctctttaagggtaaacggatttatagcattttctttcttagtatagctatttgtagttattccaagctccttggcaatatcttgttgtttaagtctacgtcttatccttaaaacctttaaatcttctatactcaatttttcacctccttcgtgattttaaatcacttatatacgtttattatagtgatttaaaatcactgtgtcaattgtttttaagaatgtttgtgattataagtcacatttatggattttaaatcacattatgataaaattaatataagaggtgatataatggcaacttttgctgaaagattaaaagccgaacgaaagaaaaataatataaatcaaactcagttagctgaaaagctttatctagatagatcatcaatatcaaaatatgagtctggaaagcaaattccagaaacacctacattagaaaaacttgctgatttttttgagatttctattgattacctattaggtaaatctgatattcgtaattatgacgataatttttctttaacttcaataagcgaaaatttaagtactaatggacttaaaacattagctgctcattttgacggtgaagaatttaccgaagatgatttagatgatatagaaaattttattaaatttatagtttctaaaaaaaaatttaataaataatatactctttattatttattaaatttaattaatgataaaataaggcggtttatcatggaaaacatttataagaaaaaaattgaagaacttaataaagcaagttcttttttaaaagatacttctactgttattggatcttttataggatttattagtgctttggttactatatttctttggataagtgaattatctcttaagctaaaattactatatactacagctgcaatttttttaattttaattattattattgtaattttgatttctaaattacgtgattgtaaaaagattggattgcttattatagatgacaataagactcttaacaaaagagtgtttgaaactacaaagcagattaaagatttacaagataaagttaatactttaaacaataataaagaagttattttaaaaagtaatgaaaaatataaaaaaagatctgccacatataaaagcggttatagttcacttttaggttgcatcgaagatgcttatgttatattacctaataatgatattgttaagaacttcaaagtaaatgctaatgaagttcaccgtaaaatactttcagaactggaggaagaaacatggatcaatataaagtagttaagattatagacgaaaatagaattgtaattaatgctggtgctagtgatggattcaagagcggaagtaaattcgaaatttttgtaaaaggtgatatggttattgatcctgatactaaagaggagctaggtactttagattttattaaagctaagatagaaatagaaactttatatttaaatatgagcgtatgtgtcaatgtaaaaaaagttgataataatccaatggcaactgctcttactactctaagtagtcaactccaatcagcttatggttatggggagaaagttcctgatgaacttaatgttgatatgtcagaagcaacaggaggattagctaattataattctaaaattaaaattggtgacttagttagagagtctttagggtaatctatagcttaatataaattattatttaaataaatataaaaataaggtgttcttaaagaacacttatatttttatattattacagtaatattttcactttatttttataggtattattcactcattttaacagaaagggaagtgataaaataatttaagaaaaaagtgaacaagttctaaaaaataatattatttaaatctataattggataactaaatatcatatagatagtatttatcaaaaatataatacaatattattaataaacaaaaaaattgctagaaaattaaatttcaaacctaagtctacaaactttgatgaagatctcgaatttttaggcaaatcattgtttttcagaaactctatcatatatggataaaaaagagaatattatgataagtttattgaaatcaaaaaactctaagcacaaagctgaaattcttattgaaaaagattaatatttaaagattttagataaaaatgaatttcttaagtcgatttaataactcactaaatgatacactttaagttaattagttcaaaaagattgtctattaattttgataattagtactttagtgaagatttttttagacaatataaaaagttttataatatatttttaaaactctaaataatatttaacgaaaggatgattcttttgataacaaatgttaaacgtattaatataaataaggctatactacatattataaataatagcgattctcactataatagaagtctcctgcctaatgacgactctaaattcaatagttttctaattaaacatataaaatcatcggcaaagagacgtggtagaaaagcagctaattatatgtttaccgctgaaaatgattcgttaactagatttgatctcatgctggaaaatgatgaagcttttattgaaaattctattgagttagctacatatttgaatcaaatatgtgaagacggatcgtatggtccatatgatttaatattctgtgaataccaaaatgatgaaaatgaaaaatttatagctgttttacttcttgagttttcaaccggttttttccatgaaattaataataatgatgctttaattaaacatttaactattcttgcatctagttcctctgaactaaaaaaatgtgcattaatacaaaaatatgatccaaatagtgattataaccttgtaataaatgacaaaaacaatgctgatttctttatttcaacgtttttacaagctcgagaatcaatggataatagaaaatctacacaaacttttattgaagaaactattatatgggttaatactgtgtgtgatcgccctaatatatcaactgaaattaagataaaattagagaatgtaaaaagtcaatgtatttcatcaattactgataatgatacaattgatatagaagcctttcaaaactttctttttatagaagagctagaacagttcaaagaggattacaacactcatctagaaagaaaaggtcttataaacaaagaaattttactaactgatgatgttacaaatgattacaaggttcataaaataaagttagataataatgtagaaataaaactgcctattgatttgcttaccgatgacggatatactgattattataatagaactattagtgataatgggacaactacattttcattaacaggtaaagttgttgatgaaagtgttaaatctagataatttaattttaaggaggagtttcaatgtttaataaaattaataacttatattctattctaaaaaattgtaattatactttagagtcagaaacagaagaagttattaaaatatcattatttaaggatctatttcaatcaaacgaaattttcttagataccattatatcaatcattgaattaaatccttcagaaattaccatcgaaagcactattactcaacctagtttatctaataagaaatcatcatttacatttcctaattatattatagagcacctaaatcatgctgaaaggcttgctacaaaaaacattaactatagacttgtaattcctaaaaatagtatattacattgtaatgaagatactaattacatttggttcttaaaagaagctttttacaaaaaacttcttttaaatccctttaataatatagatactatctcaaaaattcatacaatctataaaccaaatataattatattattacaagattctaatacttatataaagaataactctacgttaattattgacattaataacctgagtaaaattgacgattttaatgctattgactcaaacttaattttaaaaaaggatttgcgtagaagttgttgcaatattgaaattaatatatcaaatatagttcctgacttatttatatttgattatagtaattcaatttatagtttagacgaaagcttaaaaataatttataataatttatttgtattattttttataatctatttaagtaataattcaagtttaaatggaaccatagtgtcttctaaaatatcatctaataaatccatagttatagattataatatagacgatcttaataaaaatcactttaattatgataaacttattcaattatattatttgtgttataattctattaatattcaaaatatatacttagttagaaatatgctttgtatatatttatgtgatgattgtagtcatacaatgcttgatttattttatctaaaagccaatcaagtattagattcctctaatgaaaatttgaatatattaactatagggaatgttgaaagttatttttctattagatataatttatatgatttcttagataaaagtacagaatatatccaatcacaaattagtgaattaacttcaaaaatgaataaaacacttttaagcactatagcaactcttgttggagtatcctatgtttatttaaagaatgaaaatataactatcttaaagttatctctattgatatatacagcatttttgattattgattgtatatattcttttacaactcagtttttatcatatttaacatatattaaacgtcataataataaattagattacttcaaaccagttttaggtaatgaacagtatgataaaataactaataaagatagtattacaaaaaaagttaaaattagatttcatatttatttttgggttagtttaataatatatattgcgatgatagcactcggaatattatcttttatgtttacaactaaaataattgaaataattaaattatatataaaataaaagatgcacaatgcatcttttattttatatatttctattttaactaatcttctataatgaatatactatgtttgcttgaatactctttcttacattactagtaaaaatctttgattcataagcttttttccatatatgctttaacttacatatcgccatataatagctctatcagactatacgaatagtttttaaatatttccttatatgttgcactttcgaatatactgcatgaccagtatcaagtaacacaacattctcagcaaattccttcaaagcatattagctgactcctgtaaaatacagaaatcagcttttagtggcttagccccttttttttaatgtccttgacatagggtccactttaattaaaaatcagtctttattcatccactaatctatatccaacacctatttctgtaattatgtatctaggtttagcaggaacatcttcaatttttctcctaagtccagccattaatgctctaagagcttgtgtatctgaaccataatttaccccccaaatctcttttaaaattactgatgttgtaattacctttccagcattttttgcaagtaaagttattaaactatactcattgggagttaaatgtattttttctcctttaataaaaacaattctcttttcaaaatctacaattaactcccctactgaaaaacatgtttgtacagcatttatactatttttatgtaaatgtctaattgcaactctaatgcgtgctaataattctgatgctgaaaaaggtttagttatataatcatctgctcctgtatctagagcaagcaccttatctttatcttgatccctagctgatactactataattggtacctctgaccactctcttattttttctataacttcaattccatcaaaatcaggtaatcctaaatctaatataattaaatctattttctcgctaaccattatacttaatgcactttctgcattacattcactaaataatctatacccttccttttgtattatatacttaataaaatttcgtatttgataatcatcttctacaactaaaatactttcattataatttttcatattttccctccattggaagtgtaaatctaaaaattgctccacttttatcttttctattttcagctataatattacccccatgtgcattaataattgcttgacatatatttagtcctaatccaataccatgctgtccatcagtaataccattatcagaagtataaaacattttaaatatattaggtaaatccttttttgaaataccttctccattatctacaactgatatttcaatttttttctccatatctattatttgggcttcaataataatttcattacttgtttttgaatgtttcattgcattatctaaaagatttataattacttgtgtaattaacttggcatctaccagtattaatattatctcctctggtatattaactataatttcaaattttgatgtccttcgtgaaaaatgattaatcgcacttccaataaggtcatctaaagcttcgtattccttatttaaaatcaattttccttcttgtaactttgttaaactcaaaatattttctactaatgaatgtaaccaatctgcatctttatatattcctaaagctaattcaaatacttctgtgtttttttctgtcatatccattaaaatttctgtagttcccattattccagaaagaggggttcttaaatcatgtgaaatggctcttaataaattacttctatatcgttcttgaatcatttcttcttttgatttaatacgtgctctagattctcttaatctctccatagctaatgctgtactatctagcattgtaagaagtaactttatttgtgattgatttaacttatcagatatttctttaggaattcttaaaactcctaaaattgcttctcttccatagattggccaatcgcaaaattcttctcctttataataatttccttttaaattttctatgttatatttaattttattaacatcatcaacttctctataaatttgtttatcactattaattttctgaataaatactctctctggcattccattttcatcaaaacaaaggcaccctattttataagaaattatctcactaattgttccaactgcaatacttgcaatatcattcatttcattagcttctattagtctattagttaacttatataacgctctagtttctgtctctcttctatctgcttcaatcgcattttccttaattttagaggtcatagcactagtaataatagatgttattgtcataataataaaagttattatgtagccagaatcatcaacatcaaatgtataatgtggtgtagtaaaaaaataattataaacaaaagtcgatattatagaagaaattattccatatatatatcccgatgttaacctagaagacagtaaaacaaataatatatatactattactatattagtttctgaaaatcctaatattctaaacaaatatcctattaaagatgctaatattaaaaataagcttactaaaaaaagtgatttaatcttatcatttatagtattttctactttaatcattgtttttcaccttatacctataacaatatttattatttaactatatatacttctatatctattacaaatttaaataaaaatagccttatagtaatgatatcactacctaagaatattaaactcatttacttatggtacggttctccgtatcacctctaaatgaggttttatttattatttttaactacccaaaaacatacgtctacatctacaccaaaagcttgtccggcagttacattaaaattttttatttcatatctttctcttgaaaattcttttcttattatataatctaagttctcaactaacatcttgctattttctatatttgatgtatgcttgtctatcaacctataatatttcacataatctttgaattctttgttaggcactgctttaatatgagtagctattattatttcatattggtttactccattaataactaatttactatttttatcgaaatccttatttattgcatttatataaccactcatatcaactgaatcaaatgtatacatagattttaattctattatatctttaatttgattattttcaattattgctaaatctattctagattttattccacttggattatactctttagaaataatataattattatatttactatatagctcatatgcaattctatctcttattagcaattcatttttacctgtcattgaaagatatgctaattcattcttcctaaaagaactcatactttcatttattacttcaactaaactatcaatattcattcttaaaatctcctttattgattctataatctattatatagcaacatctaaattcaatacactgattccaatgtttctcaacataaaagaagaaggagtaccctctatagatactccttcttctttacttatatagtctactagactatcatttatttttagttttattgaatctatttctcttgcttcatttatagttatttctattatttattctcacttacgtgtatatgtatgagtaactatcttttacaggtattagctttattacatactttccttcttcaagctctatgtatactagagtttctttatcataactacaactttattgaactcttctatcaatgtaaattgaatataattaagttcttcttgtaatttctttaggtctattaacttcctatcattcatttcaattattaactttctaggattccattggttagataaccttccatcatagaaatcgaacctcattaccccaagaagttctttactatcatactgaaaatatttatatttgcttaacttcttcaccttctataattgttaatattacccagggaataatatagttgaacatatttctttatctacttatcattactagtttttatagtcatctttccaactcttattacacctacacatagaattctcttgacccccttttacctccctataacagaaaaagtcttaatcactatccttatagcaattaagacttttagattttatttatttcttgttttaacatttcaatgaattcttctgaaaatactttctctcttattgattcttttattagttctagttctgttacatcaagacttcttggaatatatatttcatcacctcttctggttgccttgtagacacagaatcttacttcatcattaattaataatacttcactataagatgtatctactgatattaactcacctctcacacttatatcaaaagcatcttatttttcataagctatgtctccagtttatgaattactaacctcaatattttccttttatatataaaacagctccaatttgaaataattcaaattggagctgtaaaacttaatgaaaatctagaaataatatcagaatttactgaacttctaagaaatataaagttcagtaaattatctacattattattattacctagtaaatatattgatgtttaaaaacatacatctaaactgtttaatcttcaaaaaaggaaaaataaattagattaaaaactgctgttgaaatgttaaacatagattttgaagataatttccatgatgccttttatgatgcactttatacatataaaagttttaaagaaatttacaatccataaatctaaagttaaactcgatactgatgttttatttaaacaatttagtaaaatgtataataaagagataagcaatgaagaagaatccattataaaaactgcttacaatatggtaaagactagccaatttttaaaatagttttatattctaatatatattgggatcattaagataaaatgagatgtcgcacaataaaaatggcttttgcgacacctcctttattaattattaataatcgcattaatagtggtttgcatcttattacttaattcaacgtcttttaataataccatacatattaaatcaaggagatacatggcagaaaattgtgtattaataaatttacttctatctacaaaattaggattataaactataaactttatatctgcatacttgcttatactacttccttcaaatccagtaatagatactacctttgccccattttccttagattttcttaaagagtgtattacttcttgtgtttctcctgaaatagatatacctataactaaatcattttctgagacaatagagctatttataatcatcatatgagagtctgaaatgcaatgtatattaaatcccattctcaaaagtctttgcatcatttcttcacctgttaatcctgaactaccaaccccataaatatagatattcttagctttttttatttcatttactactttaaatatttcttctttatttattaacatcttagttctttctataacttcgttataatattgatatgtatatgagaaaattccctcttcatcatttatgggtaattccagtttatttgctccaagctttattttcatatctacaaagctatcacatccgatttttttagaaaatcttgttattgttgctcctgatgttcctatttctttagctaaatcagtgatatttatattttttattttatcaccatgttgcataatatagtctgctatatctttttctttgccagaaaactcactatattttctttgtacctcgcataaaatatccacttaatatcccccgcattctaatatatatattagtcttcttatatataaccctaactattttaactgaacataattaaagtatttactcaaaaatataaaatatatgacttcaattacataactatatctaaagatataaagtaatcaattgatctttccaataataatgttaaaacattatttgaagtatatatattagaataacattaaagtacgctaaataaaagaggtagatatttgcgtctctacctcacaagtattataatacttttaaaatttcatcattgaatttctttgttattaattgtggccttgttattgcactaccaactacaacagcacatgctcccttttctaaagcaagccttgccttttcaggagtatcgaagtttccttctgctattacttctgatttacagtcctttattaaagcttctaacacttcaaagttattcatttccttagaatgctctgtatatccaactaaggtagtcccaacataatggaatcctaattctccagcccttaaaccttcttctatagttgatatatctgccataaatttttgtgaaggatactttttaaatatctcctttaaaaattcttcatcttgatttattgtagcatctaaagctataatatcaactccaacttcaacaagttcaccaacttccttcattgttggagttatatatggtttcatattttcataatctatttttattatacctattacaggtaaatcaacttctttttttatagctacaatatcttgaatgccattggctcttatacctatagctccaccttccttagccgctacagccattctactcattatataagagctgtgtagtggttcatttgctagtgcttgacatgatacgattaatcctctatctattactttcactcttattactctctccctataatttcatttattttttgctttagtggatctgcttttgctccaaatattgcttgaattccgcctttaacttctaaaacagcagttgctcctaaagctttaattctatctttatctactttacttacatcttttacagctactcttaatcttgttatacatgcatcaacgtcatctaaattttcttttccacctaatgcttctaaaatttgagaggctgtttcattcatgctatcctttgtgataacttttacttcttcactttcttcttctctacctggagtcataacattaaacttagttattaggaatctaaatgtgaaataatataatgcaaaccaaattactcctattattaataaatatacccaatttgttttttcgttaccttgaagaactccaaataatgtgaaatctattaatccaccggagaatgtattaccaattgatatatttagtatatctgatataaagaatgataatccatcaaagaatgcatggattacatataaccatggtgcaacgaataagaacataaattcaattggttcagttataccagtaacaaatgatgttattgctgctcctaagaataaaccaccaactaattttctccttgctttaggtacacaatgatacatagctaaacatgctcctggtaatccaaacatcattgttgcaaaacgtccggcaaagaatcttgttccttctgtaaataatccagtatgatttggatcagctaattgtgcaaagaatatattttgggctcctgtaactgtttgacctgcaactgttgcaactccacctaattctgtataccagaataatgggtaaatcatgtgatgtaatccaattgcacctgtcaatcttaataagaatccatataagaaagttcctattggccctaatccagctattgcattccctgctgaaactaaccaaccttggaatgttggccatattaagaagaagatagctccaataaaaattgctgagaatgaagaaactattggtacaaatcttgatcctccaaagaatcctaaaaccgctggtaattgaatgtttccatatttattatgaagatatgataccgttaatccaattactatagctccaacaacacctgtatcaattgattcaactgctgggttaaaagcagtaatcattccttttattgaagcattcataactaaaaatgaaactgcacctgcaagtcctgcagtacctttatcttttttagcaagacctacagaaagacctatacacataataagtgctaaattagaaaatattatatctcctgcagatgacataattgagagaattccttgcaaccaagaaacatttaagaatggataagcttgtacagtattaggatttgataatgctcctcctataccaagtagtaaaccagctgctggtaatatagcaattggtaacataaaagactttccaattttttgtaattgtttaaacatttatatgcctcccttattatcgaaaattatttttaccctttactttttttgaaaatatttttcttctgaatacatttacataatatcatgaaaataattttaattcaattatttttattaaaatttttttcaatattttttataccttttattgttacatttttctattattctgaaaaataaaagggagtgtttcaaaagcaactagccgaataaaaggggaaaggtggatttaatagaatccacttttttacataaacttaaatcatgaaactattcagtttatataatattaatcaacaattagtattactaatataaacagaaattatgataccaaaaaatgattctgttagattgctaagaacagtatcggagggaatagattattctgaattatataatgtatactctgcaaatggtagaaatccagtaatctagccaaaaactcttttttattgtattctatttatacaaacttaaatgatattcacagttcacgagaggtagaaaaggcatgtaaaagagatataaataactatcgtatttttgatgataaaaatatcgcatggttaagaggtttgtaatgtttgagaaaatgcggtatgagtattaaagatatgaaattatatatgaatcattgtatagaaggtccatctacaattcctcaaagaaaagaaatgcttaataagtcaagaaaatctttattgaaaaaagtcaatgaacttaatgaatatattgactttattgataataaacaatctttctacaatgatgtattaaacggaaaaacaaaatatataagcaacttaattgatatagaaaatacctaaatttaataaagatattttaattaaattattattagtaagaggtttttcaacctaagaaacttctactgttaagtgttaaaagcactcttaatttacttcatcttacgtcaatatattttatacaaaaagtcaaacttttttatgctacacttttagctaatacttttttatttatgttaacttgtctaactaagctaatagtgtagccttttatgttataccaatcctcaatgtatttttaatataataatgttaacttcttaaaaatacaatatattatataaatattcctttttattgaaaagtggaactattctatataatcattagatactccctttatctatcatatccaattttagtaaaaagctaacttatttatgatacggttcattcttcattattctaaaagctctataaatttgctcaagtaacattactctaaacaattggtgagggaaggtcattttagaaaaacacaccttataattagctctttttattacatcctgagataaccccaagctaccacctataacaaaagttatgtttgaattacccataaccccttgagtctcaataaactttgagaactcttcagaggtcatttgtttagcatttaaatccattgctataacaaacatattatcctttatcttagataaaataagctgtccttctttatccttaatttgaagctcttccttttcagatgcattatcaggcgttttctcatctggaagttctataatatcaattttacaatatctagttaatcttttagaatattcatcaatagcctgcttcaaatatttttcctttagttttcctacagaaataactgttatattcatcactttctcctcctaagtaaaacatttcaaaatttattcattattccttgaaagcatcaacatcaacgatagtagtatccttacttatatacgtactcttaggtattaatacattcagagtgtcatttttaaaaacagccctaattccactagggtctgcattttctacataatagtcctcatttacatctccgccagcttgaactatagctacagctatattctgattattactataaaacatatttctcttaacttgtagagtaatataattattatcatactccaagctaatattctccttcttagttccaggcaaatagcattgaatagtataccctctcttatgctctttaaattgtacctcaaccggggccatattatctatatttttcactaaattatccatgaaatcactattaacaatattatttacaacattatctactatattatcaattacattcatattattagctatagtattaaaagtagttgaaaatatatatggaaatatattaagcatataagcacctccaaataaataattatgctattataatttatttatctagactgctatttgacactaaatcattctttcattaatgcaaaaaagagctttgatatcaaagctcttttaaataagtagaaattactttccacaacacttcttatatttttttccgcttccgcatgggcaagcatcgtttcttccaactttgttttcatttcttacactacaagattctctgtatgccttttgaatttctcttctcttttcaggtgagaatatagcatcccattgtggtaagttgtatagatattcagccttagcttctaacatattaaagaatagtttttctaagtttatatctaatactacttcatcatttgaatttaaagattctaaatcatattgattatttaaactatcattgattccgtcaacaaatcccattatgaattcttctgaagtttcatacttcttagcaaaatctgcaattgtaatctttatagtttctttgctattagctaataaatccttatatatagcagtttcaatcttagtatattcattccagaaagctgcttcccctttagtcttaacgtattctacgaccatatctgtccattgtttatataaactcatattcatttctcctctttcttctctacgattatataaaaattatactaaatattatgtacatttttcaacatataatattaagccattttgacttcatatttagcttctttttcacaatatgtacatttgaatcctgtaattttattaattacaggaaatgtttcttttccatctataacttcatccattgcttcatccatatgttcttcacatgcatataatttttccatattttccaccttctactttaataaattaatattttataaagtaataaatttacttggattatgtctattggctaaacttaaatctaaatctgaaccaactttaataccattagcagttagtatatctcttactgtaagctctgctaactctggagtattattagtattacttaaatgacctaggataatattttttcctaagccattttttaatattttaacaattgcttccccacaatcttcgttagataaatgaccatatgcttcttttattctttgcttcaagctataagggtatggaccaaagtctagcattccaggattataattactttcaattaaaataacatctgaatctttgatattatcttcaatctcctttgtaaaagtcccaaaatctgttgctacactagctctcttatcattaacattgattgtatatcctactggtgatgctgcatcatgtggaataataaaggatttaacttctatatcctttattgccactattgatcttctatccataacctttatattatgctcttttatctttccaatgattctttccatttcgacccaagtatcttgtggtgcataaataggtatatcatactttctagataaaactcccacacctttaatgtgatcgatatgctcatgagttataaaaattccatctatttcacttggattttgcccaatttgctttaacgcttcatcgattttctttccaggtaatccagcatcaattaaaattttagctttttctgaacctacaaaaatactatttccactacttccactatataatgagcaaaaattcatttaaaattcccccaagtttatttctctattcttcttatatctgcacctaatgatctgaacttatcttcaatatgagggtatcctctatcaatatgctctatctcagaaatttcagtttctcccctagcaactaaaccagctataaccatagctgctccagctcttaagtctgtagcaataaccttagctccatttaatgattcaacaccatctatgatagcagttctgccttcaacctctatttcagctcccattttctttaactcatcagtatgcttatgtctattttcccaaatactttctgcaattaagcttcttccattagtaatgcttaataaagttgacataggctgttgtacatctgttgggaaccctggatatggtgcggtcttaacactaacaccttttaaaggtttatcaacagtaactcttacgctatcatcaccttcttcaactatagctcccatttccataagtttagctgagatagactctaaatgctttggaattacattctttatagttatatctccctttgtagcagctgctgctatcatgaaagtcccagcttcaatttggtctggtataacgctataattgcatcctactaacttattaactcctcttactcttataacatctgttccagcacctttaacatcagcacccatagtatttaagaagttagctacatctactacatgtggttctttagcaacattttctaatatggttgttccttctgccatagttgctgcaatcattacatttattgtagctccaactgaaactacatcaaagaaaatattagctgcatgtaaattttcagcgttaacacttacagctccatcttctataacaacttcagctcctaaggcttcaaatccttttatatgttgatctataggtcttactcctataggacatccccctggaagttcaactctagcctttttaaatcttgctaataaagcacctataaaataatatgatgctctcattcttcttacatcttcagtacatgcattaactgttgtaatatctgaagcatcaatttctaacgtattactatttaatttatttactctacatcctaaactagctaatattctttctaaacaatgtacatcttctatatctggtatattatcaataatacatcttccttcgctagctaaaatagctgccggcaaaatagcaactgctgcattcttagctccgttaatttctacagcgccttgtaatgctttgcctccattaatgattaatgtttccatcctattcacccttatccaaatttatatatattaatttatcctataatataaaaatttatccattttttgttttataaggtattttttaatttatccttataattttttagtcaacactattgattatatcataaagtatgcatgagttaatagggttttttcttccaaaatcccttatttttaaacttttccatgagttattagcaaatatataaattgtcaatttaagtttatgtatgatataatttaatataaaagtataatacaaaatttaacttgtgaggttataacatgaaatattatttggtagcactatttgatgatgtgtcttataaaaacttaagtccgattcaaagaagtttgtcaaaaagatttagagcaaataggaattctcctatcccttatatacctttagaggttatagaaaatcctaatatagataaactcaatactgtaatggataaaattctaaagccatataaaaattttaaagtagagctgtcatcaactgtaacactttgcgattcaaataaaactctcaacttaaaaattgaaaatataggatatataaaaaaattagatagattaattgctgataacttaaaactatatggttttaatgtaaagggtggaaatgatgaattacatctttctttagctaatataaattatctaaataaagataataagaaatttgattcagttgttgagtataaacctagtatttcaacattaaaagttaatagaattgaactttggaaaatttctaataatcgtagggaaactttaattcaaacatatcctttaaaaacaatttaatatattttttgtgaatttaaggagcattttctttaaaatgctcctttttttattgaaacgtattaaaattataattaaaactttatttttttgtattcgtttactgaccttttcaagaattaataatttctgtaaaatatattatattaatcctagtagacagggaggacacttatgaacattttaccaattgtggaattacaaaaagaaaaaaaacatggacttttaattaataaagatctctcacaatacaaattatgggcaagaaagcatcttgaacttcaagtaaaattgagctcacttgcagaagaaactaagtgttataaatactggatagatgacggcttaaatttaaataaagaaactgtatttatcaaatatgctgattttcttacacatgtaatcaatttaggtatagataagcattatattgtaaattatgaagtagtacttagacctaacgattattgcttaagcgatcaattcttaaatctatatatagatattaatgatctaataatctcaccttctacagatcatttctttaccctacttgaagacgctcttagtcttggagtaactttaggatattcagaagaagaaattttcaattcttttatatattaaccttaaaaaagcattagatgtaataataacatacatcttaatgcttttttttacaataaactttaatatattattgtctatttaggaatactatacctggaggtgataattttgtttggattaataagtgctataatctcaggtatttctatgagccttcaaggcgtttttaatacgaaactaagtgaaaagataggcacatgggaaacaaatacatttgttcaggctactggacttattttatccttaataatactttttttctttaaagatggtacatttagagaaatcaagtcaactaataagctctacttacttggcggggtgctcggagttataataacattcacagtcatgttaagtatgagatcattaggcgtaaccgtcggaacagctgttattctagtagctcaaatatctgcatcagccttaattgatgcttttggactatttggcacagaaaaggttccattttcaattcatgaaattcttggaatagcaataatgatagctggaatagtattatttaaatggaagttttaaatttattatattaacaaaaagctcctaaatcatatactatagtaatgtgaataattttaggagttttttatgttctcttcaactaaaaaactagatcctaatcttaaatttcttttagcatctagtagtataaaagattatcgtattttaatacaatatagaaactttccagattcaatttcaaaaaaaatacgttcgtatcatggcaatgttataagaaaaattgaatcttgtaatataatatgtgctcaattaaaggcaagctcaatagaattattattagaatatccagaggttaaatatatttgcttagatcaatactttactttatgtggtatgagcatatcaactgcaaataaagtaagattatcttctaaattagatgtacatggacgtggcgttagtgtaggtgttattgattccggtgtatatcctcatggtgacttaacttatccatttaatagaataagtacttttgttgacttaattaatgatttgccttatccatatgatgataatgggcatggaacttgtacttgcggaataattgctggtaatggattagcatctaataaaatatatacaggcgttgctcctgaagttactattcattgctttaaagcatttgataaattgggtaaaggatatgtttctgatattttattttctctagaagaattaattactatgagtgataaatataatataaaagttatttgtcttccatttgaaagcttatattataataagtttatttttacactctttgactctttattgaaaatagcaagacttcaatcaataatttgcatacttcctagtggaagtaataagaataccgatggatcaattacaggcattgcattaagtaataattgcataacaatttctggaatagatacaacatcatcaactataaaatcctatgaatattcatcttgtggtgcagtgaaaaaagatataaaaccaaacttttgtgctgcatgtgtggatgtagtatccttgaattcaaatacttcatatatatcttataaaaataattctagaatacatgctcctaaattagatacttcatacaaaagttttactggtacatcaatctctgctgcatatgtagctggcctttgtgcccttttatttgaacaaaacccgaatttttcattcgatgatattttatcattactgaaagtagcttcagtaccattagatcttcctagaaaccaacaaggtgaaggtaaaatagatataaataaagtattaaagccataaaaaaaacacctataaaaggtgtttttttattactctatatatttacttggatcaacaggctcattatttaccctaagctcaaaatgtaaatgtggccctgtactattacctgtacttcctattgctccaattatatcaccttgctttaccgtatcccctacattaacatatatattgcttaaatgtgcataatacgtcttcatattattattatgctctaatacaattaaatttccatagccgccattgttatatccagcttgaattactttaccctccaatgaagcatttacatttgctcctaaatcttttgctatatctattcccttatgaactgaagactttctaacttctccaaataaagaacttatatacccaccttcagttggctttgataaaaatgctatacctgcttcgtaaggatttttaatacccttttttacaatagtattaactactggagtaattatatcttgctttacagtagtttcttcagctttatttaatccatagtatgttatctctttgtaaagtagattcttaccctctacccccttaatagtttctgattcccctgccaataattcagtagtttcttctataactacttcaggctccacagtttctgtttctttcaaactaactttaaaccttagtcctgctaagtcactatttataacttctgcattatatacttctttagcaatttctccactttcactcaaattagatattctgtccttttctgtatctgaagtaattacccctaaaacttctatatggtctatattatttacatctaatccaagctcctttacataggaattacaaatttcttctagaattgaatacttatcttctattgaagagtaaaaacaaactgtactatccgatactttaatattacgcccttgcaaattaatatttgtaattgtgcttgaattatttttaaatacacttactgcacttaacttctcctcaatattatcatcattaacttcatcatccgcactcactatatttttctcatatatattattgttttttgcattagtatttttatctggtactataaacataaagctcataagcataactgttactaaaactagtattttcaacagtatacttatgttattctgcttactcaagtccatctttttacttcctcctaattgctaattttttaagcacatcacttacttttcccctcttttataattttatacatttcattatataaattgttatgttgagggttaacttcgcctttgttataataaatttaatgcgtactatgaatcagcttttttgtttataattatagttgattacgttaatgaatatatagactgattaagtttaaattctaatcaatcttaagaaaggtcgataaaaattatgagcacttttatgctaaaaaacaactcatcaaattttaccccagtaagtaatgtgtttattgaaaaatacatgccaaaagctcgtggagaatttattaaggtttatctgctaatgttaaaatataataactctggcgaaatgggtgcaaattcaacaatacttgcctcatcattaaacctactagaatcagatatattgaatgctctaaactattggcatgacgagggtgtgttaagactcgtaccaatagataaaatggggaattataatgttgaatttatagatttggttgaggattctaaatcaaaaaataaagaaataaatttacttgaagcattaaataaaacatcaacaaaagatatgctaaatgatattgaacgcttattaggcagaccactatcccctaaagaaatgactacttatctaagttggcaagatgaatttaatttttcatctgaattaattcttatattattagaatattgtgtttctcgtggtaaaagcgactatagatatatagaaaaagtcgctattgcttggcacgacatgaatataactactattgatgatgcacaaaactatataaagaagactgaagataaatgggtaaaaattcgtcatatattaaattatttaggaattaaaaatcctgaattaatgaaaccccaagaagaaatgttagaaaaatggataattgattatgcttttcctttagaagtaatagaaaaggcttgtaatatttgtttccaaagattaaatcgttctgactttaaatatattgatggtattttatcgagctggaacaaaaataatttaaaaactttagctgatattgagaaaaaagaagctagttataaatcatcacaagccaatagaaactttaactccactaaatctcaagaagttaatcctcttaaatttaataactttgaggctcgcgaatatgactatgattcattagaaaagaaattgttaggatgggataaagatgattaaaggttaccaagcagaacttatggatatgtacgaaaagactcgtactgaagaaagccgtaaattagcaaaaagacgtgaagaaattaaaaataaatatcctgaaatattagacttagatacaactatccaaaaactttgtttaaatttatctatggctgcattaaaaggtattactaatccaaatgatttaaataatattaaagatgaaattactgatttaagagctcaaaaatatgaaatgcttgtatctcatggatatagtcctgattatctaaatttgcattataattgtaccaaatgtaaagatactggtttcataggaatagaaaaatgctcttgttttaaaactaaattaattaaactttattataaagattcagaattagaagaagcagttaaaactaataattttaaaaactttaatattaatttatatcctaatcataaattaaatgatgaaagatatacacctcgtaaaaatatcgaggatatattagagtatataactggggaatacttgccaaactttaaaaacaccaatactaatcttttattctatggtaattctggtacaggtaaaacatttttatcttggtgtattgctaaagaattattagatagaggttttctagttgtatataagacttctgatgatcttttacgtgcattaaaggatataaaatttaataatgacacagatttagaaaatcttcttattaattgtgatttattaattatagatgatttagggtcagagcaaatcactgatttttcatctacagaattatttacattaattaataaaaaaatattaaaaaataaaaaaatgcttatatctactaatttaagtttgcctctaatttcaaaaagatatagcgaaagaatatcctctagattaattggcgaatttaagctatttaaattttttgcagaagatataagaattcaacttaacttaaaaagacaaaaataaaaaactgttgctaaattaattttaaattttataaataggatgcctatagtgtatcttataaaaaataaatcgtaacttttctttatagtgtattattataaaactcaaaaatacgtaaaaagaatctatattgtatgtattctttttacgtattattttttatataatttaaaaatgttaatttaattttaaaaacaaaaaaactccacttttgtggagtttttggagcttcatgtcggagtcgaaccaacaacctgctgattacaagtcagctgctctgccattgagccaatgaagcaaattaaagtggcgactcagaaggggctcgaaccctcgacctccggcgtgacaggccggcactcaaaaaggagttgtattcagattgaatttattaattcaatctgatacagcccctttttcttatgaggtgatttcatgacacagcttgaaaaattaaaaataagaacaaatgaggatgatgttatacttttaaatcagattttagaagatgcggaagccgagatattagattactgcaatagagatatcttattaccacgtatgcttggattacaaagagagttagctgttatttattataataggctagggagtgaaggggaatcctctagaagtgagggaggagtatctataagttatagtactgatatccctgaaaatattaagagaagattaaactcatataggagattaaaggcggttagattagctaatgagaataaagaataaaaaagcttactggcttaagaaaaaaataaccaccgaagataatgaaggtaatgtgtatgctgattattctgaaccaattgaaataaaagcaaatatctatccagctagtgggaagctacaagctgaaatatatggagaaagattaaattatatatttaatatgctttatgatggcccagaaaaattaaatgaaggtgatggaatatgtgtttttgtagataaagatagtaaacctgattatagaataatatcaattaaaccatattcacatcaattaatagaattggagaaaatataatggctgtaactaacataaaaaggcttatgaagaaacttgatgaactaggtggtaatagtgaggctttatttgaaaatgccgtagaaaaggcaggaaaggcaatagaaagatatgctaaagattattgtcctgaaagtggattaagtgatgataccttaagagattcaattcattttgagatggttaagaaagaaggtaagaaaaccaaagggagagttgttacaaatcacgagtatgcagcttatgtagagtttggaacaggaccagtaggagcaaaaagcggtggagttgcttctaaattggcagggaaaataacttataaatcagatggttggtatatcccagctagcgagattgaaccagcagtagcggagcaataccattttaaactagttaccattggtggagttgatttttactattcagaaggacaagcagcacaaccttatatgtatccagcagtagtaggcaaagaaaaagctataggtaatatagttagatatcaaataaacaaagaaataaaaagaatatgtaatagtaggtgataacttggttaattttaaacctatcatttataaaaaattaaaagaaatcgaaaaagaaattgaaggggttaaagtaagtgaagaatatccaaaagattggagtaaattacctgctgtaacttattcagaagaagataattccacttatgagatagtagacaataaagaagctacttgtagaattatatacagaatagaggtatggaatgatagaagtacttcagagattggtttaaaaatagatgaagcaataactcaacttggattaaagagaacattttgcaaggatgctccaaatccaagtaatctaaagcataaagttcttagatatgaaggtattgttgatattaaaacatttagagtatatcaaagaaattaaaggaggatattatatgttagcaaatggaattacgttaggatattcagaagatggttcaagctatacagacttagtaggacttcaagaagttcctgaaattggctcagagcctgaaaaggttgatgcaactaccttagcagacaaggcaaagaaatatgagcaagggataggggattatggtgatttagaatttacatttaaatatgacaattcatcaggaacatcaccatttagaatattaaagggatttgaaacaaataaaaaagtagttaaatttcaaatgacgtttccagacaaaacaaaatttaaatgggatgcacaagtaagtgtaaaaattggtggtggaggagttaatgcattaataacatttactctatcaatggcattacaaagcgatgttgatatagaacatccaggagattaaaaaaatgaggaaggtgaaaagtaatgaaatattatactttagaaattaatggacaagaattgaaatgtagattaactacacaaaacacaagaaaagttgaagaaaaactaggtggagaatcattaatgctaatgttaatgagaaaaaaggtattaggtgttggagatatatcagcaatacttcatgcatcattacaacctttagagcatggatggacagctcaaaaggtagataattttattgatgaatatatagataatgatggagatttatttacactccaacaggagtgtatggaaataatgaaagcaagcggttttttcaaggagagtccacagagccaagatcaggaagtggacaaggaacaagcgaaagaagctatggatcttttactgaattaattaatgaattatatcctatttgtttagattgtggtattacaccaaatctatttcacgaaagtacaatagatgaattaattgatttaattaaatcttatgaaagaagagaagaagccagacaaaaagaaaatatagttttaaattatatgttagctagacaaataggagagaatgttgccattttatttgataaagatgcaaaagtaactcaactttgggatttataccctgatttattccaaaaagaaaaagaaataaatgataaaagagcaagagaggcagaaatggaagcttataaagcgaagtttactgcctttgcttatagcgtaaactccaagaaaggaggaactaatacttaaatgactatagaagaattagagatagttattgaagctcaaacaagagaattcaatcaacaaatagcaaatgtaacaaggcaagtaagtagtatggagaaacaagttaataaatctctaggaaatataaaaaatatttttggtagagtaggtaaatggattgctgctcttggtataggtaaagttataaaagatagcattataacagctatggactctatagaaagtgactctatgtttgatactgtgtttggttccctcgctaatgatgtgcggcaatggtcagaggaactacagaacacactagggttaaatggttatgccattagagaaaatgtagcaactttatataatatgactcaatcaatggggttagcatcaagtgaagccctaaacctttctaaagacatgacattacttgccgaagatatggcgagtttttataacataagtggtgacgaagcatttaataagattagagctggtttaacaggggagacagaaccacttaaagcattaggtatattagtagatgatgccaccattaaacaatatgcttatgcaaatggtatagcaacaacaggaagcgagttaagtaatacagagaaagtaatggctagatatattgctatacaacaacaaacagcaacagcaagtggagatttagcgagaacaattaactcgccagcaaatcaattaagagtattacaaaataatttgaatttgttaaaaatcgaattaggtaatgcttttatgccaatagtacaagtggtgctacctatattaaattcattcgcacaagcattagtaaaagtaactagcgtagtagctaggtttatgaatgcattatttggaacttctgctagttcatctgctggaagcacaacaagtgccattggtggagttagtacagcagttaatggtgttagtgatgcatataacaatgcaggaaagagtgctaaaaaagctactaaagatgcaaaaggatttttggctggatttgatgagattaataaagtaaatcaaaatagttccgattcagattcaggaagtggatcatctggtggaggttcggcaggtggagttgatattccaattttcaacattgaagaacaagaaggtgcacttacacaattaacagggaaagtagaagagtttgcacttaaagtgagaaatgcttttataagtattgctaattttataaagaaacataaagaaattattatttcactagtatctggattagtagtaggaattataggggtttttattgctgctaattgggggactatagttagcacaataagcggaatatttatacctttgattacatggtttaaaaatttagctttagctatggaattttcaacaccattaaaagtttttagttatggtttatttgggattagtccagttgctttgggagtagtagcagctattgcagcggcaacagctgcaatagtatatctatggcaaacaagtgatagttttagacaagctttaattgatggatggaatgcattgattagtgcgttaacaccttattgggaagctataaagagagctttattattaataggagatattttaattactgtacttacacctatattacttgttttaagggatgcatggtgtactgttgtagataatatagtaaagataacaatgtcgttatggactaattgtatagcaccagtagttaaatttttaggtgaatgtcttaaaaagataattgacggactaagtgaaatatgggaagcatggaagccgactatagaaaaaataatgggtgtagtaatgttggtatgggatacttgtttgaaaccttttgtaaattggttaggaagtacatttatacaagcatttaaaaatataggagattatataaaacctattctagatagtttaaaaacaatgtttagtggtttaatagattttatagtaggagtacttactggcaattggcaaaaagcatggcaaggaattgttgatatatttagaggtatattcaatggtattgaagcaatagcaaaaaagccaataaacgctattattaaagcaattaacagtatgattggtggattaaataaaattaagcttcctgattgggtgcctggatttggaggaatgggaattaatattcctaaaattcctatgcttgcacagggaggtattgtagataaagcaacactttctatcgtaggggagcaaggttcagaagccgtggtaccattaaaaaataacactgaatggatggatactttaagaggaataatgacttcggcttttatgcaagcaatgcaaggtggagtcagaagttcaaatgaaagttatggcgtgggagatttaatcctacaaatagatggctcaattataggaaaagttgccttaaatcaattgaagaaaatgcaaagacaaggtggaattacattaattccagtatagaaaaggaggaagtaatatgcttagtattaatggagtagcaattgctactcctaagggttatgaaccaagtataactgatttagatggagaaagtaatagaaatgctaacggggaaatgattagagataggatagcagttaagagaaaattaaattgcgaatggggaccattaactcaaggggaaatatcaacattacttagtgctgtaagtaatgttttttttacagttacttttccagatccagagttaggaattacaactaaaacaatgtatgtaggagatagaacagctccagcatatttttatgatgaaaaaactaaagaggttaagtggagtggattaaaaatgaattttattgaaaaataaatttaaatgaaaatcaaggaggaataaaaatgtttaatttatttaaaagaaaaaatagaatgaaggaattggaaagaagagtattggtgcttgaaagcaatataacaaaattaaatgctcaaaaagaaaaagcaattgactttcaaaatatttgtggagaaatgcctactttaagttttggcaattataatgaaaaggttgttgtacctttagaaaatactgaatttatagatgaattagctagtcaaattgaagctaaaataaatactttagtagctactaaagcaaaagtagataaattaaaaactggagctataaatgtggagaaaaattctagtttttcaactccaactaattgggagccttatccagaagatataggagtactaaattacaagaatacttcacctaaagcaaatagaacaataattaaagtgggttcttcagaaggaaatgaaacaacagtgacatttgataaagaagaaataacgttatctgttagtaagccaagcaataaaaaagaaattgaaggtattgagactatattaaatatagatggagttgaagttaccaaaatattaaagggagatttagtgttagctggaagtattcgcaacatagaagaaactacagctaatataagtgaattaagagctgtaaaatcaaaagaggaacttaaaggattaggtaattataagataataaaaaaataaaaaggagaaggaataatgttaaaagtagataagaatataactttaaatggtgcaagtttagttaacggagcacaagtagcttatatgagtgcaactataagtagtgatggtggagcaggtgcaaatgtaaataaaactataactaatcaagaattatataatgctaataaaacagaagttagagcagatattgcagaatttgaggaacaagtttataaattggaagatgaattattaaaggctgaatctacagaagaagtaacaaagacaagaaaggtggaaaaataattatgaaattaactttaagcaatgaaaaaatagtaaacacgattaatgtattaggagatttaaataatgctaagttaccagttaaagtagcttatgcaattacaaagaatattaacaaaataaatagtgatcttaaagcttataatgaggaaaaagcaaagttaattgataaatacgctgaaaaagataaagaaggtaaattaaaaactgatgaatacggaaatgtaactttaaaagaagagtatattcaagagtggaatagagatatggctgaattattatctatagaaaatgaaatagatatacacatgatccagttagatgatttattaagttcagattatagcatttctccagctgaattagctgcaattgattttatgataaatgattaataaaaaataaggagggttaatatgcaaaatacaacagcagattataaattagaaataaataaaccttccaggtcatttgaatgtaagattacaataggaaataatatatataccaatgaggatttagttaacttaactttagagtatagtcaaccacaagaagggtttgcgataggaaatacaatatctcaaagtttagatttaacacttttaaatagaggagatattatttatagtacaagccaaattaaagttgaaataggattaaaaatagattctacaatagaatatatattaatgggtatattcaatatagatgatattgaaaaaactgattatacaactaaaattacagcctatgacaatatgataaaatttgaaactgattattttagtgaattaggtgataagccaacattaaagcaagtagtcaatgagttatcaagtaaaacaggagtagaatttgaaggaagccttcccgattacaatgtaagtaaactggagggttttacttgtagagaggttctttcatatgtagcaagtatttgtggtggtaatgctgttataactagagatggtaagtttactattaaaagtttaagtgaagttgaaaaatctatagatggcaataattatttcgactatacaagagaagaggtcaaatataaagtaggtcaaatttcttgccaggtagatgaaaataatattttatccaaaggttcaactggaacagattctatggagttgggatttgaaaatccttgggtaactgaaactatattaactgaaatatataataagttaaaatcagttgaatatttaggttatagcatgaagtggcaaggagatttatccttagatccttacgatattataactgtaacagatataaaaaatgttgtgagaaagattcctatactatctcaaaaattaagttatactggtggattaacttctgaaataggagcaaagggagaaactaaaaataaaaatagtttttcaagttctgggagtactacaaacaaagttaatagagctgtaatagaacaagcaataattaaagaagcattaatagaaaaagctaatattaaagatgtagaagcagtatctattagaactcaaacattagaagctaaaaccgcgaagattgaagaggctataattgatgttgctcatatatcagatttaaatgcaattaatgcaaacatacaaaatttaatagcagcagatgcaacaataaataatgcattaataaataaagcagatataacagaattaaatgcagttaagggtactataaatgtacttgaaagtgatactgcaaatattaaaaatttacttgctggtaatatcagtggtgagtctggtcaattaattcatttaactgcttcaaatgtagttatagctgatgcagtaataaaagatttaatagcatctaatattagtgtacaggatttaaaagcaagtacaatttctactaataaatttactatagcttctacagatggaggactttctatagtaggacctacaatgcaatttaaggataggaataataaagttagaattcagattgggcaagatactcaagggaattttaactttattttgcgtggagcagatggaactacaacacttatagaccatactggaataaaagaaaaagctatagctgataatctaataaaagggaatatggttgctacagatgccataggagaaaagcaaattaattactcaagtttaattactggacttaataaggatactaatacacagttaattaaagctagtaaagtggcaatagatttagcaggacaaactttagatgtagcttttaattctcttaaaactaatgtagatagtaaagagactagaaatttatttatagaaaaaaatacagtggatggatattataacgatactgattttattgattcttcaagttatagaactagcgattatatagaagtaaatgaaggcaaaatatatacactatgtaaatttgctgcagatggttaccatcgtatagttgtttttgataaagataaaaacagattaggtgctagattagtagaaacagacagggttttaaaatatacgataccatcaagtgtaaaatatattagagtatctatagaaaacactaataaatataagattgagaaaggtgacaatcctaatcctgtatggactgctgctccggaagatgttgacagttcaatagaatctgtaaaacaaataacagaaagtaatagcattactataaatgtaatgcaagggcaaatagcaacagcaattaataatactcaaatagttaaagatggacaaactatattattaaaggatgattacaataggacagttgctacagttaattctataaatagtacaattggaacacatacaactaaactaaatgaattaacaggaagtatatcaagtgtagatactaagattaatagtgttcaaagagatttagaaggaactaagagtacagttagtagtcatacatcacagataaatggattaaattctacagtcagtacacaagggtctagtataaatcagctaaaaaatgaaatttcattaaaagttgaacaaaccgatattaataatgctgtgacatctttaaaaattggtggagataatgttataagaaatggaaattttacttatagcatgagtgattggtcggtacatgatatgagttcaggtggaacttctaaatcagttgctgttgaaaatggtggaggtgattggaaacccgataacaaaaaagtgttagtgataagaggtacaaatactactaatagatatggggttataagttctactataaaacttatacctaaaactaagtacactatttcaggatattgtgcaggacatagagtaaataaaatacaagttaatgttagggataggcaaggtagtgatgcaaatatccacacaattgatataaatcctgttagtggcggatctactttagataagtggtgcagatttgaaacgacattcactactacttcaaatactgattttgcattaaatctatattctgttaactttgcagataatggttatgtatggttttgtgatgttcaaattcagcaaggtacaaaagcatcagcttggataccttgttcagctgacatagacaattctatatctaatgtacaaacacaagtaactacaacaagcaataaagtagcaactatagaaactaatttaaatagcattactcaaaggatttcaagtacagaaagtacagtaagtacacatacaagtcagttgacaactgtggatagtagaataaatacagctaagaactctgctataagtactgcagcaagtgatgcaacttcaaaagctaattcagctcaaactaatgctgtaaatagtgctaaaagttatacagatggtcaaataacaactgtaaatcaaactataactaataaagtagcagaaataaaagctacaacggatagtatttctcaaaaagtaagcgctacagaatcaaagataacaactattaatggtaatataagtggtttaaccaatagagtttctactgctgaaagtaaattaacagcaacttctcttactaccacaataagtagcgcaataagcggaggaacttcatctataagcacaacacaatttgtaatggataagagtggacttactataaaaaatggtgcgttaacaatccaaaacaaagctggaacaacagttttaaatagtgatactaatggaaacttaaaaataacaggagaaataagaagtcaatataaccagcagtgggttgcgcttaattctggtggattaacatttcaagactctcaaagaaatgagcagatgttaagagttggacttgcttatttcacagctaatagggatatgaatggtgttgaatttgctatgccacagtatagtgactttataaggttttctcatattgcaaaagcagatttgaataatggatggtcaagtgcagatactacatataatttctttgagttatggagtggaactcaaacctttggtggttctaccagaaataaaggaatgacagtaaattcacctttatacattaataaaggaataaaattatattcaggtacaaatcacttatctgagataggtggggctgtatcttggaataatggaactggtacagtaactaatatgttaggtttgtatggggacaatggtgctatcctcggatataaatctggagaagatttaaaagcaagatttctagtaacagaaggatcacatccaggaacaggggacaatataatcagttgggggaattataattttaacggttatacattccataatgctaaaatagttgctacatcattaagtgtaagcggaagtaagaactgcttacaagaaactaaaaattatggttcaaggcttataaatgcttatgaaacagcagaatattactttggagatttagggtttggcaaaatcaacgaatatggagaatgcttattatatatagatgatatattcttagaatgtgtaaatacaaatgctcagtatcatgtttttacacaagtttataatggatcaataaaaactatagaaagatataaaacatatgttgtaattaaaggagagccaggaacaaactttagttggcagctaatgggtaaaagaattggatatgaaaacaatagattagaaacccaagagatagaaatacaaggtgaaaataaaattgaattattcggagatgaagatttcaaagtaagaacaagtgaaaatgctttaatgagcgcattaacatttgaattagaagatttattattaatggaggaataaaatatgaaacttttaacaggatttgcaatagtaaaagataacgtaggaaataggatagcttatactacatcagaggtagatgaaactggaactattctgtcaagtaataacaaagagagttttgttgtacttgacccagaaacaaataatctaattgaacaattagaagaaaagataaaagaaagaataaaataaatttaataagagaataagttgttaagtggaacctattatcaggaggtaacttattctcttatctaaggtgaaatagttcacaataatatcttgtgagaaaacatcaaatatattcatagaaaaaactaggagccgaagggttctttttttatatttaaaattccaagcgattgtagaaaggagagcaacagtggaaaatgaacttattaaaacaatagtaagtcaaggggcatgggcggtactttttgtttggttgctgattgatacgagaaaagaaagtaaatctagggaagaaaagcttcaaggaataataaataaaaatcaagaagtaatttcagaactagcagagaaatttgatgtagtcgaaagcatccaagaagatgttatagatataaagattaaattagagaaggtgggataatatatgagtaaatttgtaactaagttaacaagtttaattgaagtaaaaaagattatagcgctaatagttataacagtattttgtatattaagtgcaaaagaagtagttnnnnnnnnnnagtagttagtacagaacaatttactacagtagcaataatgatagtcagtttttattttggacaatcaacagtaaaaggaacagttaaaaagattgaagaagagtaggagtagaccctgttctcttaatttataaaaatatattaagaaagaaggaataataatgagtaatttaaattttggagtaaatgatggacatacaataagtggaccaggttcaggagcagtaggaagaataaaagaaggtgaacatacaagaaaggtaggaaatgaagtaagaagattattaaaagaaagaggaaataccgtttataactgcactgtagattacgctagtactacaaatgaaagcttggctctagtagtgcaacaagcaaatagacaagagttagattggtttattgcaattcattttaatgcagcaggaggaaggggagtagaagtttacacatatgaaggtagacaatatcaagatgctattgatgtttgtaataatatatcaagtgtattaggaattccaaatagaggagtaaaaggtggtacaggactttatgtaataaaaagaacaaaagctaaatctatgttgatagaagtttgctttgtagatagtgatgatgcagataagtatttatcagtaggtcatgaagcagttgcaaaagccattgtagaagcattggacgagcatataagtaattctattcaacaaagtattaataatgatacttcaaatgaaagtaatataaatcaatgggtttgggagttacaatctgagtgtaataagcaagggtttagcaatcaaaaggtagatggttatcctggaccaaaaacattggcaggatgtccagtactaaaaaggggatcaaaaggaaacattacaaaattagtacaagaaaaattaataagcttaggatatgatctagaaaagtttggtgcagatggagcgtttggagatgaaacttatgaagcagtagtaaattttcaaaaagctaatggattagaaccagatggagttattgggaagaaaacatgggaatgtttaatatatagataataaggaggctagtagttaggagaaatcctatttactagccagttagttagacttaaattttaatttattctatttttcatttaataaaacggttaactacataagttacaataaaaatacttaagatataaataaaaacaaatgtacgtcctaattcaagtgaaaatttatcccccattatagtcggtaaattaatgagaataatagctatagatatccataaaagatataaaaaaacatttattaatttaaatttgttaaattttttattcataaatactcctttatatattaccaatgataaatataatctccataataatctcctgtactagccttgaatgcccaaatagtacgatattgagggtttgttaatggtgcacgaaacatttgtatttttgtataaactcgtccacctgcacattgacttgctataacacctaatgcacctattcccattgcagcaataacgcctttaggaccaagggtacctacttttgttgcaattattgcagcaagagcagctgctgtagtcgcttttccccaacttatataagtgctactacttgattttgtttcccattcataataagctcttggagaaaagaatgattcttcataaatagtttctttttcagtcataacaagttcgttattcaaatatatatctttagatattttatcttgcacaattttttctatattattatttgaatcattaattattgttattactttatttccatttttatagcaatatttatatgtatagttaattccatcaatagttataatttctacttttttttcagcatatacatcctcttgcttattatttttctcatatgctttagcttctattatcggagtagtaaacattatacttagtacaaaagttaaagttagagcaatttttttgaatacacttttcataataacacctcttttatttagaatttaaatttatatagcttgtccattaacactatatttaaataataacacggaaaacgttttctataaagactataatttgacaataatttttgatataataaaatttagaggaaaataatatataataatgaaatttgttcaataaattggtgaggattatatttaatttagaaaataattaaaagtagatgtattaaaaaatataacaatattattatttattagaataaatataaggagtaatattatatggtaaaagagttactagaagaacaaagagataaaaaaattttagaattgaaatcaaaaaggcatttataaataataatgaaaaagtaaagaaagcaaagaaaatagaaaatataaagaagaagcagttacttaaacaggctaatttaagagctaataaagagttaaaaagtaataacaatgcagaagtagaagtgtatgctagtaaaactaagctaaagagaaaggaattaactcaaataaaatttgaagtggatattacagaaaaatataagtttatttataattattataaaaaatatatagattctattattgatatagaagaaaaggttagctttattgaagaacaaaaactatatgcagaaaatagttttggctcatttagggggagtggaattaacaatatattgtcaattgatggggctcttcttattggattgatggccactattatagctgagtttattaaattttcagtaagtgaaatatgtagagcagtattaaataaagagtattttatttctaatgaatgggattttataactgctagtggaatatttatatgtattattttatttagaatgggaagaaactctaaaagtgaaaaagaggatgatatttttaatggactatgtataagggcattagaaaagattgaaagtgaaataactaaataatttattaatgtaagtagcatttagagtgctactttttttattgacatagtaaaaaataggtattaatatattattcaagtaaacatgtgttcgatacagactgaataagggggattattatgagatatgatgatttaatagaaaatgaaagtaaaaaaggagttactattattgaggcctcttttaaaggacaagctaaggggtactattgtgatagttttattattataaatagtaatatagatacagaaacagaaaagaagtgtattttggcagaggaattaggacatcattacatgacttcgggcaatatacttgataaaaaagatgttaattcagttaaacaggagaatatagcaagaaaatgggctagtaagaagttaatacatgttgttgatttcattaaggcttttgaatttggggcaaagagcagatatgaaattgcagagtatttagaagtaacagaggaatttcttgatcaagccatagattattataagcaaagatatgggacatatgtggaaatggataactatataatatattttgagccttattttggtgtttttaaactattaaggtgttcatcaagaacaccttaatacatgtgaaaccaatttattgtaataagatataataataaaattaattatatatgatgctataagggggaagatttgtgaaggtagcaatctatagtagaaaaagtaagtacacaggaaaaggagattctatagggaatcaaattcaaatgtgtaaagattatataaatagaaactatccagaagaagaaataatttttgttgaatatgaggatgaaggttatacaggtgctgtaactgataggccgcaatttaaaaagttaattgctgatatccctaaaaaaaaatatgatgcattgatatgttatagattagatagaatatcccgtacagtttcagatttttcatcaacattgagctttttacaaagtcataaaactaattttattagtataaaggagcaatttgatactagtactccaatgggaagagcaatgatatatatagctagtgtttttgcacagttagaaagagaaacgatagcagaacgtgtaagagataatatgatggagcttgctaaaaatggaaggtggtcaggcggtaggctaccgatggggtataagagtgagaaagtttcttatattgatgaagatggaaaagaaagaagtggagttagacttatacctgatgaagaagaattaaaagttgttaaattagtttatgaaacttatttaaaagaaggatcacttcataaaacagaagtatattttacgcaaaataatattaaatcaacaacaggtgtattattagaaaaaacttctttaaaggtaattttacaaaatcctatctatgtaaaaagtgatgaagaagttataaagtatttaaatgataatagttggaatgtatatggagaaccagatggtaaatcaggattattaagttataataaaacaaaatcaataattaaagatggtaagtatgtaaaggttaataaagagaaggatgagtggatagctgcagtgtcaaattgtccagggataattgattctgatcaatggataagggtgcaggaacaatttaaaaaaaataaagataagttcccgagattaggcaaaactaataatgcattattaacaggaaaaattagatgtggtgaatgtggatcatacatgagggttgttcatggaagagtttcaaaagaaacaggtaagaaattcttttattatacatgtgctatgaaaactaaaagtaagggtgcgctatgtaaaagtaaaaatataaagtcagatcagttagaggaaactgtattaacatctttagagatgctaggaaaaaataaaaaagagtttttagataggattaaaaaaagtaaagatattaacaatataaataaaaagagaaaattaaagattgataatataaaaaaggaaattaatgataaaaataaagtgatcaatggattacttgacaagcttgctttatcagatgacatatcagatataattttagaaagaattaaaaagttaaaggatgaagttagaactttagaaactgaattgaataaaatagaagatagtattatgtacgataagtgtgaaaaagtttcaatagatatagtgtctgaattattagataaatgtgcaaatataaagtcatatccgtcagaacaacagaaatcaataatagatttattagtagatagtattacttatgattcatctacgcagcaagtaaatgttaatataattggatgtaatgaagagtctaaaaaaaaaataactttcaattattaaatgaaattttaccgttgcattttagaacacactgcacatgctaagcttatgactacttattacccattacaaaagcttagaaagattccagggtttactagctcagtcggtagagcacttgacttttaatcaaggtgtccggggttcgattccccggtaagccaccaaaaaaatgcagatgtggcgaaattggcagacgcactagacttaggatctagcgcctttggcgtgggggttcgactcccttcatctgcaccatttatgcgaaagtggctcaatggtagagcgccaccttgccaaggtggatgttgcgggttcgagtcccgtctttcgctccaaatatgcgggtatcgtatatcggtaatactccagccttccaagctggaaaggtgggttcgattcccactacccgctccattagaaaagacaatcttaatgattgtctttttttgtttttaaatttgagtgtgaaattttataacctctaggagaagtaccagttgatttcttaaacatttgactaaagtaagatgaattagaaaagccaactatagttgatatatctcgaattgaatgatttgtagtgactaaaagatttttagcttcttcaattctcttattaattaaataattaataggggatattcccatttgcttcgtaaataaatgaaccaagtgaaatttatttacataacttaaacttgataaaatatctaaagtaatattttcggaataatgagagtcgatataatttttaattttaacacattcaatatttagcttttcagggttagtggtaataaataaattagacttagcatttctagatatatatataataaataaagtcaaaatacttttacatgccaattcatagttggaatctttattttcaacttcgcgtactaagttatctaaataacttaaaatttcagctttatcattattaaaattcattattttatagtaaataggaggggttacctcaaggcctaaataagggatactatcattagctaaggccaagttatttattccaaatacaatatactctaattgatcaaaagaattattagtagatttttctgtatgagagcagttgggattaataatgattaaatccccctccttaatggaaacgataacaccatctatatccataagtccatgcccatgagttataaagaagatttcagtaaatggatgtgaatgagatgtgctatgccaatcattaccgtatttagatttacttatataaagtaattcaaaatcaatattatatatattcttttcattaaacatatatcgtgtattactcataaatcacctccaaataatattcaatagttaaattataacattaattatagtaattataaaagaataaaagatatttaggttatattgcgcaaatagcaatataactaaaaaaatgagcaataaatttattgtgtaaaagtttacaaaaaagtaaaataaaatcaaggatttaagaaaaaacaaggggagtgattttatttgaaaaaagatagtaaatctaaaaatttatttatagcgctatcagttattccagcatttattttatttcttatatttatgattattccaactttaaatgtattttggatgtcattatttaaatggggaggactaacaaataataagaaattcgtaggattaaataatttttttatattgtttaaagatgaaaaatttataaaatcatttcaaaatacattgtttttaatagtatttgtaaccattgttactttagtaatagcaatagcattagcagcggtattaataagaaaggatattaaattcaatgatttatttagaatagttttttacttaccaaatatcttatctgtagttgtaatatcagcaatattctcagcaattttagatccaagtcaaggtatattaaatgcaacattagatttattaaaattagaaaattggaaacgaatgtggcttggagatcctagtacagtagtatggtgtattgcagtagcaatgatttggcaagctgttggttattatatggttatgtatatgtcagcaatgagtagtattccggaaagtttatatgaagcagctgaattagaaggagcttcaaagtttaaacaattttttagcataacattacctcttgtatggggaacaataagaactacattaacattctttataataagttgtattaatttaagtttcttatttgtaaaagtaatgactagtgggggacctgatggagcatcagaatcgttcttaggatatatgtacaagcaagcttatggtaattcttcatatggatatggaatggcaataggagttgtaatattcttattttcatttggattatcattaataattagcaaagtaacagaaagagatgtaattgagtattagggggtggtaagtatgcaaaacatatctgaaagtaagataaataccaataaagattctgtaataaaaaagaagaataaaagaaaatcatctaataaattaatgaaagcttttatatatttatgcttaatattgtttgcattaagtatattgatacctttagggtggtcaatacttgcagcatttaaacataaatcagagttttatggaaatccatggacattgccagaaggattttatttagaaaactttaaaactgcatttatcaaatcacatatgggagaatattttttaaattctttgtttgtaactgctttagcattagcaattcttttagtaatttcaattccagcagcatatgtgttatcaagatttaattttaaaagtaaaaaacttttaaatactatatttgcagcaggattatttataaatgttaactatattgtagtaccaatattcttattaatattagatgcagataaagcaataaaacaaatatttgcacttccattatcaatgactgtatttttagataacaaaattgtactagctttagtttatgcttcaacagcactaccatttactatttacttgctatctaattatttaaaaacattaccgagagcttatgaagaagcagcaatgatagatggttgtagttatttgcaaactttaattaaagtaataatacctatggctaagccaagtattataactgtaatattatttcaatttttagctttctggaatgaatatattatggcattaacactacttcctaattcgtcaaaaaccttaccagttggtttattgaatttaatgcaagtacaaaaaacggcaacagattatggtgcaatgtatgcaggattagctatagtaatgattccaacaataatactttatattttggttcaaaaacaattaactgaaggaatgacagtaggcggtataaaagaatagggggaatagcaatgagtaaaggtagagttacgatacctacagatgataattttataaaggaaactatggaaatagccgaaaaatggggggctgatggaattagagattgtgatggatttaagctaccaaaagaaataaaaggattggctgaaagaatatattcaacttatttcgttgctcgtggagataataaatgggcagaggctaataaggaagaattacaacaaacatatttaatgacaaagcatcatgttgcaactgaagataagctagtaataaaaataatggatggatattttggacagcaggttcaaccagacatttatcatgatataaaagtttggtgggaagtaattgatagaacgagtaatgaggttatagatgtttctttgtggaaatataatgagaaaaatcaagaagttattatagaaaatacaattaaatggcatgaatatacagtaacatttttggcttattgtatatgggatccaactcaaatgtataatcacattacaaataactggggaaataaaccacatgaaatgccttttgatgcaagaaagccaaaaactaataaatatatttttgaagctatgcataagtggcttgatgaacataaggaatcaaacatagttagatttactactttcttttaccattttactttagtgtttaatgatttagctaaagaaaagttcgtagattggtttggatatagctcaagtgtaagtccagagtgtttagaagaatttaaaaaggaaaaaggttatgcattaaggccagagcatattgttgatcaaggatattataattcttcatttagagttccctctagagaatatttagattatatggattttcaacaaaaatttgttgcagaaaatgtgaaaaaacttgtagatattgttcatgaagatggaagggaagtcatgatgtttttaggtgataattggattggtacagaaccttatggaaaatatttttcttctataggaatagatggagtagttggttctgttggtagtggagcaacacttagaatgatttcagatattccaggtgtcaaatatacagagggtagattcttaccatatttctttccagatacattttataaaggaaatgatcctacaatagaagcgaaagaaaattgggtaactgcaagaagagcattaatgagaaaacctgtagatagaattggatatggtggatatttatcattagcatataagtttccgaagtttgttgattatatcaaaaacgtttgtgaagagtttagagaaatatatgataacattggaggaaataaaccttactgtggattaaaggttgcagtacttaactgttggggaaaactaagaagttggcaaactcatatggttgcacatgcattatggtataagcaaatatatacttacttaggaataatagaatcactaagtggtatgagttttgatgttgaatttataagctttgatgatattaaggaaaagggaatttcaaatgatatagatgtaataattaatgcaggtgatgcaggtactgcatttagtggaggcgataagtggcttgataaagaaataataactactttaagagagtggatttataatggtggaggttttgttggagtaggagaaccttcagcaatattatatggaggacatttctttcaattatcagaagcgctaggtgtagataaagaattgggattttcattgagtacagataagtattttaatactcaacttgataaacatttcattacagaggatgttattgaagaaattgattttggggaaggacaaaaaaatatttattcaaagagtaaagaaacagaaataatttgttataaaaatggagatttattgatgtcttcaaatgattatggaaaaggaagggcagtatatattgcaggacttccatattcaactcaaaatacccgcatacttatgagaagttgtttctatgcatcacataaggagaaggaaatgaaaaaatggtatgcagataatttgaattgtgaagtatcagcatatttagaaagcaataaatatgctgtaattaataattctcatgagaagcaaagtactattgtatatgatggaaatggtaataaaacgaaaattgaattacaaccaggtgaaattaagtggaataagattagttagtagttaggagttaacgtataaattatgttataaattataaatttaaaaagagtgtaatataggcttgttaattagttttattattagctataaacttctaactaaaaattcataactacctataggagtgattttatgattaaaaagttaatttacagtttggtatttatagtatctgtatcactagttataaaaggaaacacaattcatggatataaaggattgtctattatgcttataggattagcatgtttacttgcagagttatattcatacaatagaaaatatcaataaaagggagagaatatatatgaaaccaatattattaataatggcagctggattaggaagtagatatggtggattaaagcaaatagataagattggaccaaacggggagatattattagagttagctgtacatgatgctataaaagcaggctttgaaaaaatagtatttattttgagaagagaaattgaagaggagtttaaggagcttataggaaataaattagaagaatatgtagagataaaatatgtaattcaagaaataggtaatctcccagaaggatatacagttccaaatgaaagaacaaaaccatggggaacaggacaagctattttatgcgcaagagatattatagatgcaccatttgtagcaataaatgcagatgatttttatgggcaagaggcatttagaaagatatatgagtttttaatcaataataaagaggaaaatatgtatggaatggtaggatataagctgtgtaacacactttcagaaaatggacacgttgcaagaggtgtttgtaaagttaaggatggttatttggaggaagtaattgaaagaacaaaaataataaaaaaagatgaagctgctttttatacggaagatgaggaaaactggatagagcttgattataattcaactgtatcaatgaatatgtgggcatttaatattaacatatttgaagaattagaaataggatttaaaaggtttctagatacagaagttaagttaaatccaaagaagagtgagtattttataccttcagttgtaagtgagttattaagtaatggtaaaatatctgttaaggttatggaatcaaaggataaatggtatggggtaacttataaagaagataaagacattgtaagaagtgcaattgaaaatatgattaaacaaggagtttatcataagaatttgtggggggaaattaagagaaaatgtgtgacaaaagtttagaaaaaacagttgaggcacttaaaaaatttaatttcgagggcgatattataagagtagtaccatttggaagtggaataattaatgatacatttttagtagtttgcaatgataaagatggaaataaaaatcaatatattattcaaaaaataaataatttaatttttaaaaatattaatcaattaatggagaactactgtaatatatgtgattatttaaaagctgtaatatcaaaaagaggtggagatgtagataggcaaactattactgtagttccaactaaaaagggtaagaatttttattgtgactctatggggaattgttggagaagtattaagtttattaagaatacagtaacttatgatgttagtgaatcaccgcaagatttctataaggtagggagaacatttggaaaatttcaaaatatgctatcggattataatgcagcaaaactatatgaaacaatacctaattttcataacacaaaggaaagatataagtcatttataaaatctgttgaaattgataaagtaaatagattagataatgtaataaatgaagttaattttattattgagagaaaggaggatacatctatattgttagatttgcttgaaaagggggaattacctttaagagtaactcataatgatactaaaattagtaatattcttatggatgcaacaactaaagaaggaatttgtgttatagatttagataccataatgccaggactttctttatatgatttcggagatgcaattagaagtggagcaacacatgttttagaagatgaaaaagatttaaataaagtatttattgatttagaattttttgaagcatttacaaaaggttttttagaggagacagcaaatagtttaactgaaaaagaaattgaattattaccaatgtcagtaaaagtaattacattagaacagggaatgagatttttaactgattatttaaatggggatgtttattataaaacaagctataataatcaaaatcttgataggactagaacacaacttaaacttgttaaggatatagaagaaaagctagatgaaatgaaaaatatagtaaataaaagtttaagtaataatatagtagaggggtaatagtatgattaaatttggtactggtggatttagggcaataattggagaagattttacaaaagataatgttcagcaattagctagagctgtggctagaaaaatgaaagatgaaaaagttgaaaataaaactatagttgtaggatatgataggagatttttatccaaagaagctacaatgtggatatcagaagttttagcatatgaaggaattaaagttttatttattcacaggggagtacctacaccattaattatgtttgaagttaaaagattaggtttagattatggaatggcaataactgcaagtcataaccctgcactttataatggggtaaagttatttactaagggagggaaagatgctgatgaaatagtaacaaatgatgttgaaaggtatatttataaatatgaaaatgaagacttgaaatcaatttgttttgaagaggctatagaaaaaggattagtaatgtatgataatccttttaatgaatatatagattgtattttatcacaaatagacgtagaagcaattagaaatgcacatttaagagttgttttagatccaatgtatggtgtaagtcaaacatcgcttagaactatacttgcaactgcaagatgtgaattggatgttattaatgaaaggcatgatactttatttgggggaaaactacctactccaaatgctgctaatttaaaatctcttcaaaattatgttatagatagaaaatatgatattgggattgccaccgatggagatgcagataggcttggagtaatagataataacggaagatttttacatcctaatgatattttagttttattatattattatttattaaaatataaggggtggaatggccctgttgttagaaatattgctacaacagaacttttagatagagttgcacatagttttgaagaagaatgttatgaagtgccagttggatttaagcacatttcttcaaaaatgatagaaactaatgcaataataggtggggaatctagtggtggattaacagttaaaggtcatattcaaggcaaggatggtgtttatgcagcttctttattagttgaaatgatagctgtaacaggaaagtctttatcagaaatatatgaagacatatgtaatgaatatggaagattatatatgactgaaagagattataaaatgacccaaaagaaaaaacaagatcttattgatatattaatggttaagagagaagcaattgaatttaattatgatattgaaagagtttcctatgaagatggatataaggtttattttaaaaatggtggctgggtaatagttcgtttttcagggacagaacctgtattgagagtatttgctgagatggatactttggaaaaggcagaaaaaataagcaaaatagttgaagaaaaatttgatttataaaataaaattaaattgttaaaaacgcaaaataactaaaaaatataacaataagcttattgattaaacgtttacaaaaatatagtatatagttataaaaggtgagggggagaattttatgaagtttaagaaattatcagtgatattaagtgcacttatggtggcaacattgtttgcgggctgtggaaactcaacatcaagtaaagacgcagagactaatgaagatgttgcaacttcaagctctgaagaaacaatattaaaaatagctgcattagatggtggtcgtggagttgaacactggaacaagcttgctgaaaagtttgaggaaactcatgaaggcgttacagttgaattaacagctgcttctaatttagaagaaataattagaccgcaaattcaaggtgggaatgtaccggatttaatatatttagccactggaagacctgaagcattaacagaaacttttataaatgaacaagctctacatgatttaactaatgttatgaatatgactgtaccaggtgaagatgttaaggtgaaggataagatattgccaggatttttagaaacatcagctacagctccatatggtgatggaaaagtttatttagctcctttattttatagtccaacaggactgttttataataagggattatttgaagataagggatatgaggtaccaaagacatgggatgagttttttgctttaggagataaggcaaaggaagaaggaatttatttgttttcatatccaacagcgggatattttgattctgtaatgccagcaatgttagctgcttctggaggaatagaggcatttaataaagcaatgaattatgaagatggattttggacttcagatgatgcaactagagtattagaaaccatagcaaaattaaaagattatacagaaccttcagtagttgcaaatgcaaatagtgataattttaaaaagaatcaacagttaattttagataataaagctctatttattcctaatggggattggttaccaagtgaaatggaagatgctcctagagcagagggatttgaatggggatttactgcatatccagcatttgaagatggtggagacatgtattcttataactattttgaacaaatgtatataccagctgatgcagctaatacatcattagcagaagaatttatggcttatatgtatagcgatgaagctgttggaataattgctgaattaggtaaatcagtggttcctgtagaaggtgcaattgatattgctagtaaatatttagatgacttacaaattgagatgttaagtgtttatgataatggtgcaaagccagttatgggaggatttgtagcaacagaaccagttgaaggagtagtttggaatgattcttatatattaataattgattcaataatgaatggaactaaaactgtagaagattgggaaactgcattaacaagtgcatctgataaattaagagaagctataattaaatagtattatttaggcgttatgaaagtagcgcctatttttataattctatttatgtatttttatgacaataaagattaataatatagttaatagttagggggaatgggacatgagaaaagtataaaagaaggaagatataaaaatgaaaataataaataaaggttttagagtattaatattaactttaatcttaatacttcctagcagcagtattaaggcgtttgattatgaagatattaatgtaaaattaataggacatagaggagcaagtgcatatgaaccagaaaatactattccctcttttgtgaaagctgcagagcttggaatgtggggagcagaatgtgatttgtattcgcttagagatggaagccttgttatattccatgataatgatgttgatagaatgacaaatggtgttggtaaaattcaaagtatgagtttagttgaagttagggcgctaaatattgatagtggaaataatattaaaaagtataagaatttaaagatacctactttagatgaatatctaatatgctgtaagaaaaataagttaattccagtaattgaatttaaggaaattaatgttgagaatgtaaaagaagttgttgataagattaaggggtatggcttagaagatgaagctataataatttcaacatcatatgaatggataaaatatattaggcagtatagttataagattcagtttcaatatttaaatgatataagtttagaaaatattaatttattaaaagagtatggtaattatggaatagatgttagaagagatagaataactgctgaaaatgtaaagctagctcatgaaaatggagcaatagttaatgtatggggagtaaatactgaagaagaggctaatatgcttatagatataggggtagatatgattactagtgattataaattaaaataaaaaagtattatttatatgtataataaggaacgagcttgtcaagaattaaaataaataattcttggaggttagaaatatgaataaagtttctttggttggtaatgtagtaaatgatttagagttaaaagattataagaatgatgaaggtgaaggtaagtatgttagatttactttagcaattaatgagtacagcgttagaaagaatgaaagaattgccacattcgttgaagtagtggcatttggtaagaaggctgtaatattagctcataatgttggtaagggaagtaagctagccgttgaagggaaattaaggactagtaactattcaaatagtgaaggtgaaaagaaatataaagtagacataatattaagtgaatttacttttattgatagtaagaaaaaggctgttaatgaggtagttcaggaagaagttccattttaatatataataatgacataatgaaatctcaaatttgctttgaattattttatagaaaataataattagtgaatttgagattttaattttattatttaatatatttagttataaggataatattatctttataaaaattactgatttggtaagtattgaataatgaattggaataccttaaaatatagagtaacataaagtttttactttataagtaggagattatgttatgaaagaaaacaggggaggatacatatgaaggttataaaaagaaacggaagatttgaagacttccaaattgataagttagaaagaagtataaaaaattctgcaagtgacataagtattgttcttaataattcggatataaaattattatgcaatgaaataatgaaggaattatctatgacatgtaaagataataatgttacgagtagttatgagattgttggtgttactgtaagtgttttaaagaataataattttgcaaaagttataaatagttatttagatatataatagtgaaaaaaggtatcgcattatcaatattgcgatacctttttcatatggtgcacctagagggactcgaacccccgacgcctggattcgaagtccagcactctatccaactgagctataggtgcaaagaatatattatttattataatattaaaaaatataaaattctataaaattagtttttttatatattatttagtaagagtattgataggtatgtggtatatagatagagtgtaaatacataaaaataactataaaatcatataaaactctaaaaatactaggtgttttatcatactctatacctggtgtatcaataatagaaaaagagagaaaaataacgaaaaaacaaagtaaatggtgaatagttttcaataataatatttataatatatttaaggcgaaaaagctgtgatagaatagtcattgtccttgagggaaacagtttagaactgaaacaagttaaaaaacttgaaaaaataagttcaaaaaaatgttgacacgaaagtgacaaagtgataagataaggaagtcgcttgagtgcgacacaagaaatgatctttgaaaattgaacagaatatagttaaagtaaaccagcaattcttttgagagtactctcaaaagaattgctggtttactttaactatattctgttcaattttcaaagaccatttactctgtcgcaccgaagcgacttccttatcttatcactgagaaacttttctgtcaacacatttttttcaacattttttcgtgttgtttgtgttaataaaaaatttgctttcgctctttcgagttacttgctgtccctcaggacaagacttataatatcacctaaaattgattaaaatatctgataatatattattatataagattatattcaatatactctattttttattaatatactctcttttactcatattgatacactaggggcagtgttatattttttctataaagttatccacttaacgcacattatccacaagcttatatcaatagtattatacctttattaacataattaacattatccacaagtgtattttcttatttactctcttccctttatttaaaagattctattagtctttatattattatcttagaattttatatcaaatatttttaataattaaattaactataaaattaaaaataaaaaaagaacacaaaagctattctttcatgttctttttgaaaattaaattaaactactctttttttaggaattacaactggattctctcttaatccctttacctcttcattatcatcaattaatgttcccttatctgtaattgcatgattcatcattacattacttcctataactgtattttgtagaattacacaattctctattatacttccctttccaatataaacatttcttcctataacacaattcttaacttcaccttcaatataagaaccatttgcaattatagaattgcttacactacttgtagacgtatattgagttgggcaagcatcctttggctttgtgtaaactggaaagtgattatagaataattctttatttactttttcatttaaaaagtccatatttgcattaaaatatgcatttattgagtttatacaagctaaataccccttaaactcatatgctccaacctttaatttatctatatttccattaatatagttcttaatcttcttatatcttccacctctgatacattcatatatcatatctataaaaagatcagtcttcattatatacatttccatatttatattggcactattttttaatccaacattttcgccaactccaataactcttgaattttcatcaaagtttaatacttggcaatctataaaattatcttctacatgtttaacatttttataaacagtagttacatcatttccttgttcaatatgatatttaattaattcgttataatctaagttacaaaccatatatgacgaacaaattaatgtatattcttttttactatggtcaaaataatcaatattatctaaaaaattatgaacatcatcgtgtactggatcctcatcactaaaattaaatacttttaatccatcttttttacgatatatatcccatggcttcccatttgttaaatgatccatcaatgatcttgatttattttttgtaaaaatacctattgcttcaattcctgaattagtcatatttgataaaataaaatctactactctgtatctacctgctataggtaatgaagctaacggtctatgtctcgttagctccgttgttctttgttcattttcatctaaattaattataccaatacagttattcatcttcttatctacccctctatcttaaacttccattgcttctatcacactaccgctttttatatcctctttagatgctataacagatattttttcaccatttcctactttgcaatcttttcttatttttgcttctccaccaattatagctttattaataactacgttatcaccaatcttagcatctgtcataattacagaatccttaataacagtgtttttacctatatatacaccttcaaataatactgaattttctactgttccatgaactgtacatccttcaacaactaatgaatttttaacattcgcatcttttcctatatattgagctggtcttacagggcttacagagtaaatcttccagtcatcttcataaagatttaatccactttccctctttaataaatccatattagcttcccaaagactactaattgtacctacatctttccaataacctttaaatggatatgcaactaactttctaccttcatttaacattttaggaattatatttttaccaaaatcattacttgattctttatctttttcatcttcttttaatgcttgtcttaaaaccttccaattaaatatataaactcccattgaagccatattactttttggattagctggcttttcttcaaattcatatattgataaatcatcattagtattcattattccaaatctacaagcctcttccataggaacttctattacagcaattgttgcttcagcatttctttctttgtggaattgaagcattttatcataatccattttatatatatggtctcctgataaaattaatacatattcaggatcatatctatcaacaaattcaatattttgataaatggcattagctgttcccttataccagttgcctcctttttcttcttggtatggtggtaatatacttactcctccatctcttctgtctaaatcccatggagtacctattccaatatgagcatttaattctaaaggtttatattgtgttaaaactccaactgaataaattcctgaatttgagcaattacttaatggaaaatctattattctatacttccctccataaggtactgctggcttagctaatttttttgttagtacacctaaccttgatccttgtcctcctgctaatatcatagcaaccatttctttttttctcactattatccccatcccctcttaatttaatatgccgtaatatacttattacgctactaaattacattttcttatttatgttaaatttatttttttgactatataattactatctaatagattcatactaattaatctattactaaaatgctttctttaaaagcatataaaaattaaatctatattaaacatttgtaaatttcattcattattttaaatttttggaaccaatctttttaataaggcactttatttatagaaaagtgccttattttttctataaaatctttaaaactttatattcatgagattttaactctatttcaatttgcccattctttatttcatactttttatcattgctcattaaatcaataatagtatttccatcattaacatcattcaatgaaatattctctttcttttccatagtattaactacaactaatatcttttcattgcctattagcctttcatatcctaaaacttcattattaaagtctaagaattttatttctccactcttcaatgcctcttcattagctctaatattagatatcttaatataaaaacttaatatatccttattttcttttccccaaggatatgcctttctattataaggatccttacctccagttagtcctgcttcatctccataatatattaacggaacacctggcaatgtcatttgaataattactgctaattttagcaagctaatattgttattcaaaatagttaatactctttcagtatcatgatttcctaaaatattcatagttgaataaaaatattcttttggatagttttccttaagagacatatactttttaataaaatatctatttcctatataatttctaactaaatctaaaattatttgcctcaaaggataatttgtaactgagtctaactcacttccaaataaatattctcttcttctattataactatatttattagatgcatcctcccatacctcaccaatcaataccccttcattctttactgctttaagtttcttttttaaaattttaataaactcatctggcaattcatccgcaacatctaatctccatccactcgctccaagttttaaccatttttctattattgaattattatttctaattatataatccaaataacttggatttaattcatcaacattaggcatattagaaaatccccaccatgcttcatataactttggataatcattaaatctataccatcggtaatatggtgactgcaaagattgataggctcctaaagaatcataattcccaaacttattaaaatacttactatcacttcctgtatgactaaaaaccccatctaatatgattctcattcctaacttttcagcttcactacatagttccttaaatatttcttcatctccaaacatttgatcgattttttcataatctccagtatcatatttatgacagcttggtgagtcaaatattggattaaaatatattgtgcttactcctaatgattttatatacttcaatttctcctttactcctaaaagatttccaccataaaaatcccacctaactatatccccgtgttcatcttttatatacattggatcatcatcccattttccatatataaaagtattttttttcggatttaatactttaccgtctttattcccattgaagaacctatctacaaatatctgatatataatccctttcttataccagttaggaacctcctcattagaatatatagttatttgataacttttaggatcattaaagtatgtttgcccttctccacctaaggattccatattattaccatataaaatatttctaccacaatagttcaccctaaaatagtaatatatcaatccaaagcagttgctagtatctatttccttttcataaacccaattatttacatatccattccatcctatttcattcatttgaacttctacttgattattataaaaattgatcaaattaatataaactgaacattttttactagtccatatcctaattcgcactttagttcctatagtaactgccccaaatggatttcttaattgaagattatgcgaatcatggaaaacttgtatatcatccaaattcacattcctcctataaattcttatatattacagtagagccccatataccagttgcatattctttaattgttctatctgatgaaaagatacctgaatgtgctatattaactccacacatcctttgccatttttctttattcatataaagtttatttactttatcttgtgctgctaaataagcatcaaaatcctttaatacaaagaactcatcattatatgttaataaattctcgtatattgttctaaatctatctttatcattgcaatatttaccattaattaaatcgttagttactctttgtaatctcggatcattattacaaacttcccatgatgagtatccaccttgtttatgataattcaatacttcttcagcatttaatccaaaaattacaatattatcttcaccaacctcatctttaatttctatattagctccatctaaagttgctattgtaatagcaccattcatcatgaatttcatattagatgttccagaggcttctttagtagtagttgatatttgttcacttaaatctgttgcaggaattattttttctgctaaagatacttgataattttcaagcattactactttaatcttatcatttacccttggatcgttatttacagtttcagcaactctgcaaattaattcaattatattctttgctagataatatcctggtgctgcttttcctgcaaatataaaagtccttggtattatatctaaactaggattttcaattaatttattataaagatccattattcttaaacaatttaatgtttgtcttttatatgcatgtattcttttaatttgaacatcaaaaattgaattagtatcaataactattccatttgatttataaatctcttttgctaatctttccttgttatccttttttatctctctaagcttttctaatactgctgaatcatctaagtaatttttaaagttttctaggtcagtaggatgctttataaagctatccccaattgtatctactaaaagcttagttaatttaggattagaccttattaaccatcttctatgtgtaataccatttgttttattattaaacttagatggatataagtaatagaaatcagacatttccctcttctttaatatttctgtatgaagttttgcaaccccatttacactatggctacctactatggctaaattagccatccttacatatccatcacctataatagacattcttgatatcttatcccattgtcctacatacttattccataattcttcacagtaccttctatttatttcttctataatcatataaattcttggtagcaaactcttaaacatatctactggccacttttctaaagcctcagccaaaattgtatggttagtatatgaaatagtattttgagttattctccaagcattttcccaagatagaccctcttcatctaatagtattctcatcaattcaggaattgctaatgttgggtgagtatcattaatatgaattgctattttttcatctagtaatttaatatctcccttatgcttcttatagtgtctaactatgctttgtattcctgctgatacaaagaaatactgttgttttaatctaagcattttcccttcatagaaagaatcctcaggatataaaactaacgaaattgcctctactgaatttttatatgaaattgcctttaaaaaatcacctctactgaaggatgaaaaatcaaattcatttgatactggctctgcactccataatcttaaggtattaataacttcattttcatacccaactataggagtatcataaggtactgctaatacaggttcgtaattaacatgggtaaatgtaagctttccattaacataatcagaaattatacttcccccaaacttaacaatttcagccttatcttgttttttaatttcccatacatttccttctcttaaccaattatcagatgcctctacctgttgacaatctacaattttttgttcaaaaaatccatatttatatcttattccacaaccatgaccagcaatatttaaagatgccattgaatctaaaaaacaagctgctaatcttccaagtccaccatttcctaaaccttggtcatgttctaaattttcgatttcttctaagtcaatatctaattcacttaaagcatctctacagatatcccttattcccaaatttaaaagaaaatcacctaatagccttcctaataagaattccattgagaaatagtatacttgtttttctccagtttgattatatctattattagtatccatccaagtactaattacatagtctctaaccaaactccccaatgcttcatatttttgttgattatttccttcttttaattcctttccatgtaattgaacgaatttattgttataatctcttttaaatgaattcttatcaattgatagcatatatctacctcctaatagcttgtatccattaaggtctcttgactacttcttcatataatactttatattgcatagctgattttttccagctgttatctgaatccatagcttgtctgattatgttattccaagcatctttatcgtcgtagattgttaatgcatattctattatttgcattaattcatttgagttaaagtttttaaatccaaaaccattacctattccagtgtacttattataaggacaaatggtatcttttaatcctcctgtttctcttacaattggtatcgtaccataccttaaagcaattaattgtcctaatccacaaggctcaaataatgaaggcattaagaacatatctgttgcagcatatattttatgagctaatgaattatcaaatttaatatttgctgaaactttatctggatatctatattgcagattcttaaatgtttcttcataccaataatctcctgttcctagaacaacaaattgtatatctttttgaagaagtctatcaattatgcttactattaagtcacatcccttttgatgagttaatctagatattaaaccaatcataggagtctctgccctttgtggtaatcctagttctttttgaagagataacttattttcaaccttatttgctattgaatcccaagtaaaattcttaaatataaggttatccttctcaggatcaaattcttcataatctatcccatttactattccctttaagaaatcacttttacatcttagtaatccatcaagcccttctccatattgttgtgtctttatttcttctgcataagtattacttacagtagtaatttgatcagaataatttattccaccttttaaaaagctaactgatccatgtaattcaacactaccattagttaatggcatatagtcatatccaaatagctcaggcaaaacattaggcacaaagttacccttaaacaataaattatgaatcgaaaatacagttttcatatttgagtaaaactcgttatttttatactctaaatttaataggactggtaccatacctgtttgccaatcattacaattgattatatccggcttccaatctatttctttaataaattctaaaactgctctattaaaaaatgcaaacctttccccatcatcataatatccatataacccatctctattaaagtaatattcattatctatgaaataatatacaacatctttatatttatattgaaaaactccacaatactgatttctccatcctacaggaactgtaaaccactttataaattgtaaattttgctttagttcatcctttatattcttatatttgggtattactaccctagcttctacacctagttcagttaaggattgaggtaatgcccccattacatcccctagaccaccagtcttaataaacggatgcgcttctgatgctgcaaacaatactttcatctattcacactccctatttagatttattattcataacttttaaaataatagccgccattggtggaacttttatttttacagaatatggctgattgttgtaaggaatttcttctgctaacaatacatcacttataacttgtcctgaccctccatatatttcactatctgtattaaagtcttctacatactctcctaattttggaactcctattctgaaatcatatctaactacaggagtataattgcatacaaatatcaaagattcattattctttttatcatgtctaataaaagagaatatactttcatcacaattatctgcatcaatccattcatatccttctggttcataatcattttcccatagtgctttattttctttataataatgattcatatctttaaagaataattgtgtctttttatgcatatcattttcttctattaggttccattgtaactcttcatactcatgccattctgtaaattgaccatattctgaccccatgaacattaacttcttccctggatgtcccatcatatgagctaagtaaagtctaagcccagcaaacttattccaatagtctccccacatcttattaactaaagaacccttaccatgtacaacttcatcatgagatattgacaaaataaaattctctgagtaattataagccatagaaaaagtcatcttattatgatgatattttctatacaacggatcttcattaatatatgttaaagtatcattcatccatcccatattccatttaaaattaaatcctaatccaccatcttcaacaggctttgatattttaggccatgctgtagactcttctgcaattgtcattactgtcggaaattctttatgaatcgcagtattatactcttttataaattgcatagcttctaaatttccattttctccataaatattaggataccattcatcattttctctaccatagctaaggtaaagcatatttgataccgcatcatttctaataccatctatatgaaattctcttatccaaaagaataaattcgaaattaaaaagcttttaacttcaggctttcctaaatcaaaattaaaagttccccatcctttattatctcttttccatgcttcatcatattcataagttggagttccatcaaacatatataatccatgagcatctttacaaaaatgacttggcacccaatctaatattactccaataccagctttatgaagttcatcaaccaagtatttaaaatcatttgctgagccatatctgctagtaactgaaaaataacctacaccttgatatccccaagatgcatctaatggatgttcaatgattggtaaaatctctacatgtgtatagcccatatcacttaagtactttggcagttcttcagcaatctctttatatgttaaaaactctttatttttagttttccatgatcccaaatgcatttcatagatgtttattggactgtcatacatattaaatttttttctcttcatcatccaacttctatcattccatttatatttatcagattcactaacaattgatgcagtatcaggtcttttttctgatttaaatgcatatggatcagcttttaaactatagattccatatatattttctattgcatatttatatttttctcctgcatttattccctcaataaatatactccatataccttcatctgataccttttccatcttatattcatcttttatttcaaaatccgaaaaatctcctactacatacaccttttttgctcttggagcccaagttgtaaatcttacccctttttttcttttttctgaaacatgatgtgcacccataaatccatatgcttcataatgctttccttcatgaaataagttaatgttttcaggagttaactcacatttcaccttttttcttgtagtcttacttactttatcattatctaaactcttactctttatttttttattaactgatttaacatcttcaattgtctttttagtattactcttcttaatagctgctccattttctcctctcatgtaaataccccctcatctttatactgatgtaaattgttttttagcaaatcttatcctttattttataattttaccatcaagcatttatactcttcaacttcttttaagcgacatttaatctgataaatccacttatgtattttcatatcactccttttattgttgtattttgttgtttttagggtgttattttttcttttttgtctatttttcagaaaatattacactgctttttttttaatttgctaatatatttttttaattatatgtttttataacaccttgaaatcttatatttcaaagtaagcttccatttacaaaaaaggggctgtagcactaaataattagtgcacagcttctttttgataaaaaaataaatccaagactctacaagtctaggatttatgataaaatatttttcattctaacaaaaaaatcttacacaaaaattatactgtaaatcgaaagttttaagtgataaaacttccttttgatatagagtgcataattccagaaaatgattcattgagattactaagtcagtttgtagaatagatggatttaactgaactatattctacttattctaagatgagagaaaatcaagtatcgccaacgaacatgctaaaaattatactttatggatatatgaatggtttctattcttcacgagatatagaaagggcatgtcttagagatataaattttatgtttttgctcgaaggggcatcctctccggatgactcaacatttgcttttaattacatatcaacatttataagagtcatttttaatgctaaaattaatatctattaagtcactcgttaaaactccaacatttcccttaaccatttaactataatttaatataacaaaaaaagatacctagtataaactaagtatcttcttacctggcaacgttctactctcccacacagtcacccgtgcagtaccatcgacgctgtagagcttaactttcctgttcggaatgggaaggagtgtttcctctacgccatcatcaccagattattgagattgttatctcaaaattgcacatgaattatatttttattggtcaagccctcgacctattagtatcagtcagctacatacgttaccgcacttatgcacgcaaggggtcaagggttcgaatccctttacctccaccaaagctacgattttaaatcgtagcttttttgttgtataaattagtaataatttgtcgtaaaataaattgaaaatattattgtttttttgctatgattttaataaagtattatataatagtgtatatagtatttctaaaatagatttataatgtgttcttatataaaaataagaatgggagtgatcatatggaagaaaaaataaatttagagcaaagaataattcagttgaaattgaaaaaaagggatttagttctagctgggaaagatacaaaagaacttgatgatgaaatcaacaatataaaaaatgagttagataaattatctttgatagtaaaataaattttataacaattttaatttaagcatattatattcaaaaatatcataataattcttgagggaattatattttcatgtaaatataggagggactatttatgataagaacagtggtatgcgaaaaagaaggttgttcaggaaatactttttttatagaaactcaagataataatttggtactaacatgtgaacattgtaagagcaaatatgaatttgatataagttattatgattttattatattatcaaattgttctaaatgtaataacgatacttttaaggtatttagggatactgaaaaggaaggaatatatgcaaaatgtgttgaatgtggttcaacaccagaaaagatatatatagactcagatggaattcaagtatcttatgaagtgaagttattaaatgatattaaggaattaatgtatcaattagaacaaagggtatgtaatgtagaagttaaattgcaggatcttgaaggtagtcagggaatattggaagaatcgttagcgtatattaatagatatttagttgaaaaaaactaataatagaactttataaattataatagggagaagatatgaaaaacaaaagaataataatgaattggatattattaatagcttggatgatattaatatttgtaatgtccaatcagccagcagatatatctaataaacaaagtgatttatttataaatatactttcatttataggaattgatttaaatagtactttaggatcaatagcatcatttgctgtgagaaagacagcacattttactgagtattttatattatattggttagctgtttcagtatttaaaaattatattgaaataaagaaagcaagaatatattctttagctatagtattgggatatgcaattacagatgaagtgcatcaatattttataccaggacgagaaatggcttttagagatgtgatgattgatttttcaggtggattatttggctgccttatagatttgctattgcataaatttaaaaataaaaaagttaatagaaatagttcatcaaggattgttgctagataattgcaatgatccttttttatagcttaggaataatagaattattatagataacctaagtataaataaagaaattatacacctatttaactatatgtagatagagataagaatgaaagtgttaatacgtcaaattttaaatttaccttaataattttaatggaattgctagaagtttaaagagaagaaagtgaattatgtactatttagttcattaaattcataaagattaagtatgactttaaataataaaagctaataaaaatgacaattaatcgatctatataaagaaaggtgggtgagggataatactataaaatagtattatcaataaattatgaaagaatataattataaaaaccttagaaatgtaggattaataggacatggagcaacaggaaagacatccttagctgaatcattattattttatacaaataatacagataggcttggaaaagttgaagatggtactactgtaatggattatgaacaggaagagaaaaaaaggggaatatcattatcaacatcagtagcttcttttgaagagaataacattaagattaatatagtagatatgccaggatactttgattttcaaggggagatggctcaaggaatgagagctgtagatattgcaactatcgtagtgtgtgctgcatctggtattcaagtaggtactgaaaaggcatgggactattgtgaaaagattaaattaccaagggcatttttcgttaataagatggatagagaaaatgctagctttgatagtgttctagagcaaatgaaagaaaagtttggaactagtgttgttcctattcaatacccaataggaaaagaaagtgattttaatggaattataaatgtaatttcaaagacagcattagtatataatgctaaaacttccaaaatggaaccgtcagaaataccagaggagttaaaagacaaagttgaagaatgcaagcaaatggtaatggaggctgctgccgaaactgatgaagaactattagataagtatttaaatgatggtgaattatgtgatgaagatatatataatggattaataaagggttgtgctaatggtgatatagcaccagtcttatgcggtagcgctataaagatgattggaatcaaatcaatgattaatagtataattaaatgttttccatcaccggagcattcacttccacaaaaagcaattaatttaagtaccaatgaagaggttttcataaatattcatgatgagaaaccattttctgcttttgtatttaaaactattgcagacccatttgtaggtaaaatatcattatttagagtaatgactggaaagataagtggagaaatgactgcattaaatactaataaagataagcaagaaaaactaaaccatttattctttatgaaaggtaaaaatcaaattcctacacaagttatttcagctggggatataggagcagtagcaaaattacaatatacagcaactggagatacattatgtagtgataaattaaagattatgtatgataaaattaatttaccaaatgcagtaatgcctatggctgtattaccaaagtctaaaggtgatgaagagaagatatctttatcattatcaaagttaatggaagaagatcctgtatttaaggttgaacgagatgttgaaaatgcagaaactataatttggggattaggagaaacacattttgaagtaatagctaatagaattaagagtaaatttggtgcagatgtaatactacaagagccaaaggttccttacagagaaactattaaaggggtttcagatgtacaaggaaaacataagaaacaatcaggtgggcatggtcaatatggggatgtaagaattaaatttgaaccaaggcaagatggagagctggatttagagtttgtagataaggtagtgggtggtgctgttcctagaaattttataccagcagtagaaaagggattaagagattgtatatctagtggggtcttagcagggtatccagtaataggtcttaaagcaacattatatgatggttcttatcatccagttgattcttcagagatggcatttaagatagcagcatcaatagcatataaaaaaggattggaagcggctaaacctattttacttgagccaattatgagtgttcaaatattagtaccagatagttatatgggagatgtgatgggggatattaacaaaagaagaggaagagtaataggaatggaaccagaaggaagaatacaaaaaatatacgcagaagtacctatgagtgaaatgtttacttatgcaacagatataagatctatgacacaagcaagaggaacttttataagtgagtttttaagatatgatgaagtacctgcaagtgaggtaaataagattttagatgaaacaaaaagaataagagcagaagcataataaaaaaagtatttataagtcatatcaaaatcgatatggcttatttttataaaaaataaaatatgtagaataaaattgataaaagatgcataaaataaggacagttaagaaatattatatataataatatggggtatgagagaaataataggagggtaaaacaatgccagactataaaatggatattagagggaaactaggacttagtgaatatagcgatatctatgattatatggggatagtagataagaatgataattttactataacagtagatcagttaaataggcaacatgtaaatattattacctccatgttaaaagaaagtaatttttctatattagaagagggaataaataatttaggggattattatattagtgccaataaatataaataaaaatctctaaagtacttaactttagagatttttatttaaaaaatatttatgtaaatgtagaaaataatggtttataattgtagttagaaattattttgaggtgagttaaatgaatatacaggttaataatgaaggttctatagaaaatataataggaagtattctatgtaataataatttaactatatctacagcagaatcttgtactggtggattagttgcagcaaagttaatatcatatgcaggaatatctagttcattcttagaaggtgctattacttactcaaatgaagcaaaagttaaaaggcttggagtaaaaaaagacactttagaaaaatatggtgcagtaagtgaagagactgcaagagaaatggctgaaggaattgctaaagaaagttcatcaaatgtatcaattgcaacaacaggtatagctggaccaggtggtggtagtaaagaaaaaccggtaggattagtttatatagctgtatatcttaatggaaagacaaaagtggataagtgtaattttgatgggaataggaatgaagtaagagatttagctacaaattatgcaattaatatgatgataaaagaacttaaggagaataattatagataatttagataacgaaaaataatcccaataatattatctaaaacattaacgggattatttttgtatataaataaaatgggggagaggcgattaactatgaagtttaaaacttcatttatattattgtcatcatttaaatttaatatacattaagcaaataaaatttttaataaaaggagaaatttatgaaaaaggttgctagagccaatacatactttttaacaattatactattacagctatttttgcctgtatcaaaaatattcagtttatttaatataacagatgttaggttgatgctttttataagtcatacaattacatttatcattccggcgataatatacttaatagttactaagcaatcagcaaaggatgtattaaaattaaacaagctatattttaaagatgcacttctaattatattgcttgcatttgtatgtcaacctataatgacattcttttctttaatatcacaattcttttttgaaaatgaaataggtaactttatgactgaaatagttagctcaccgtatattatattattactcttagtagctgtattacctgcaataacggaagaaataactatacgtggagtagtattatctggatataaaaataagaatatatatttatcctcaataataacaggattattatttggaataatgcatctagatccacaacagtttttatatgcaacagttttaggatttgtactagctttagttgttagaataacaaatacaatatttgcttcttcattaattcattttttgattaatggaacttcgataactatacagaaagtaattagcttaatcccacaaagcgattcattaatggaagaagcttcggaaataagtataagaagtttacctgtcggagaaaaattagtaatggctgctacatatggaataatagcattagcttttggaatagtagctttttttatacttaaaaaattagcaaatttgaatattagaagaggaataattaccaaagaagagatgagtataaggcattctaatagtgatgagaaaatatttaatatgcaatttagctttattataatactttattttatatttatgctaagggtaccaattattagatttattataagtttaattatgtagtatataatattagtctatgtaatgaaagactattaatagtttttcgttacatagactttttattattagaaatttgttgatatgtctttggatgtagagcaaataaaagaaaaatcatttttattaatccatcctcgacagttataaggtgtatcaacaggtaaacttacataaaaccaagtttcattacttacaatggcactgtctaatattttaacctccatcttgacatttaatgttttaagctttggtgaatcggtagtaggtgctagaaagataatagattcattattggctattgcagttgttattgatgggcgaataaattgaacatttagatattttgtttttgcaatagaatttctatattcatttctaatactattaaattgagaggtagttcttcttattctatccttggctactgctaattttttttcgtaataaaaatacataaatataatgattaatattaatactaaaaatataatgtatttcaaagttacctccagaataattattatataatatatttatatttagagggtcataaaaaattactaataaaaaatatacttatagattaactaaaaaaatatttgacataatataaaaaatattgtatattaaagttgttaaggctcgatagctcagtcggtagagcagaggactgaaaatcctcgtgtccctggttcgattcctggtcgagccaccaggaaagcaacttactaaatagtgagttgcttttttttgttcttataaatttagaagtaataaataaataaaaaaagataaaattaattatttaataagtttttataaagccttataaaaagtaaataataactctttacaaaaaatgttataaggagtaaaatgaatttatagtaaattcatttattgttaagtttaaattaagatatatttaataatttaattatataatttaattataaagaataaggaggatatgcagatggtagaaaagatgatgctttcagataaggattatgaatatttaactaaaggaatagcaggtggagttggtataggaaccattattggaatgctactacaagatataatacttggatttgcagcaggcggagttcttggaattatactagcatttgtatattcttattacagaaaaataaagtcacataaaaacaaagttgttaaaatagattaatatgaaaaaagttagagccattataaaaatgacctaactttttctttatatattttctatttgccaatcaataggttttttattaacagatgtaaggaattgattaatttttgaaaatggtttacttccaaagaaacctcttgaagcagataatggactaggatgtactgaagatagaactaagtgtttatcattagttattaattttttcttactaatagcattgttaccccataatagaaaaacaacaggatcattttttttattaactaaagatattatcttatccgtgaaaatttcccaacctttattcttatgagagttagcttcgccagctcttactgtaagtgaagtatttaataaaagtaccccttggtcagcccatttttttaaatagccattattaggaatatagcatcctaaatcagaattaagttctttatatatatttaataatgaaggaggtattcttacacctggatttacagaaaaacttaatccatgagcttgattaggtccatgatagggatcttgccctagaataacaactttcacattttcataaggcgtataatgtaaggcattaaatatatcatatttatcaggatatattgtttttgtattatattcatgttttaaaaaatctctcaaagttaaatagtattcttttgaaaattcatcttctaaaagttcattccagtcattttttaatatttgtttcattttaatcacctctattaagtgtattttagatattaagttatgaattttacataattataacacaaacggtacctagtatatcaatagtagaaaaatgaagaaaaagtaagaaaaatcatataaaattagaattatttgaataaaataatgaaaaaatgaaaattataataaataaatagtgttaagataaaacacgtcgctgatgacaaatcaaacaaatgagttgattggtgaggcgaatgatacttatcatgtcgatgataaatgtcaaaaaaacttttgaaaaaaagttgttgacataaaattaaagaaatgataagataaggaagtcgcttcggtgcgacagagtaaatggtctttgaaaattgaacagaatatagttaaagtaaaccagcaattcttttgagagttgctggggtaaattacaaatcattgttaacattaatttataaaactttaaaactggtatacctacaccatagactccaaattctataggttcaagaataatattcatctgtaataattcaactatatttcttattatttcttctgtgcttaaatcttttacatcttctgttatagaaccaaatttactttttattattgaacttcttttcatacaatcactatcttttaatttttcataaggtactaaaggtaacatattaattaactcctattcatttattatttttgatagttctgatacatcaaaattaaaattaactggtgctgcatcttgatttttttctattgatttaataacattatttaactcttttattaaagaaattttctgtttttgtaaagttgtataagctgaaaaaataggatttaagccatcatttagcctatctaacataccgtttttttctatattatctttacatactgataataatttatcacatgaaattagttcaattaatagcggctcaattaattggtattggctatcgcttaaacttctaatttcttttacataagaagaaatatttttattcattctcttacttttctgttttatctcttgcacttgctccaaatgttcaagttccttttctcttatataaatttcacttgctgaaagatgctttcttctactttcacttaattcatgtaatggcttccttggtcttcctctcatttgtttaattctccttttttatattaaaatgctataattgtgctataaataaaatgtcatcaaaccattggtattactaggttttcaaccttttcaagtgctataaatcaaaaaaacaactatttataacacttgttgtaagaaagggttgggctgttctgtggagtacctcaaaaaaattaaattattttcatgggggtataccttccaactttctttttatccttccgttaccttctctatttcatttcattttttattttaaattttttcttttctttcaatcttatatttatactattgaattgatttaaaattattttatttgttacaactcaatttaaactaatcaaatctataaataattactgtcttattatcatcaatagaattgaggtctattaattcatgtatagaagtatttatatttatatgtttaagagtattaattaactgttctattgtgatatattcttttcttgttacattaaataaatttaattttataattaattcttttatttcttcttctttcatttgtttatttataaacttatctttattaatatttaatatcatattatttatttctatattatctttaatatctattctcattgtctatgctccttgtatatggctataaataatataggctacataatacccctataaataaaagcagctattaaactgctcctggtatcatatagcctatatgtactatgggtttaattctaagtatgtataattaaatgcttgatttattaaaccagcttcatctttaaaattagctggtggaatatacatcttactaaatccattgctctctaaagctttctttattttctttttccagttattcaaaccagtatcacaatatagatttaaatatattacatactttgttatatcttctatattatctgatgttgaaaaagtatcttctgaatagttataaactatacattctctttcttcttctggtctttgtagattgtaaactgaaattcctaaagcttctaaacaatttattaacttttcttccatacacttacccctactttaaaattttgtctaatgcttttccaacttcatcttctaatatatttaatattgtatcttttgcattatcagaagctttatcaaaccaacctacatgattttcaactcttcctctaaatgcttttggtctaccaccataattgttataaccccaatgctgataccataattgtttacattgctcccaattcgtgctatctatacccattgcaccttgtaaaccaccgtttttatatcttttaattgtaccaatctttaaattatctcgtccttcatatgtatcatgcggagcatcttttttgataatctccaaccctggtttcattgcctttcttaatgaactaacaccaattctattaccaacttgccctaattcatctagggttttaaataaatcttctaatccatctgctgcaacataagccatttattttgcgtacctcacttttaactcataaaatctatttttttcatcaacattaataatagatgtaatatcatatttcttaccatttaataaaactatatcagtatctaaaatttcaaaattcggctttcttatagtaattaatttttcatcaatataaatttttccttgtgcttctaaatcttgttttcctttgtaacttgttacttttgctctacatgataaaacatctttataaatgttaattggtctattatcttcatcttttccaggtatagaacgttgaattttaattggtgttcttaattctccagggtttagtttaaaagctgccattataaatttaccttcttctttatattaattaaagccttaaaagtaccgttaatatagcggcttccgtccattgttttattttctaccatatcagatattaataataatgttggtggtacaataaagggtatttggtctaattcttcaatagataatccagtatattcaataatataattcttagctgcatcaatatatatttcaaattccattacttccaatagattttctttatttattggaaattgaagatattgagaaactatatctaaattaatttcactaaatttcataattatctccttaataactctaatctttttctttttatctctaaatcaactggtatatataattctctagcttcaaccattgtattattgtaagctggttctttatctaatattgaaacctcgaataattccatatcttcaatagttctttctaagtaatttcccacttgtttaaaactatcttttaatgctctaaatccaaaactcattccagttattaaaccatctttaaccgcatcatataaacccttttcactatcttttaatgttgcatataaataaactccatcttcctcggctctcaattctaccttttcagctaattcaaaatatggcttatggttataatagaatttaacattttcattaatagccttttgccatgtttcctttggtactacttccctaaatgctccattctttcccctaagttctttactcactccataatcatttactttacaaactaaaagagaactattatctagttcccttacttctaatttactatattgcttttccattgttttctccttctcctggtgctgctgcaattggttttccatctgcattaatcgcagttcccatattaggtattattatatttccatctgggaataacataactttaccttgtgataaatttaaaaactcttctttattatttaaaataaatgggttttcatctaatcttaaacgaccttcatttattgttaataatcctttatcaactgctaaagcaatactttctattcgtgtcttttcgtctgctctatcaaccatttcacaattaaacctaaaaataatattcttttctttttcagatgataataataattggcaagttaaagcattttcaatacaacttactaatggagcaatagtatattttaaatactcactatcattctttatattatataaattaaataatctttcaacatcttctataaatgcttttttattatctaatgattgaaatttagttaaatcaatatctaaagttttataatctattccttcctctaagataattgttttaccagcatttgaaccaccagaatataagtttttccaactttctttcattcggttaattgtttgctctgttaatcttgaagaactttttaaataaccagagggcattgaaatattattgataacactttctaacatttcatcatgtgccattaataaagataataatttatcactatttaatatccccttattaccagtatcaattattaaaacttcataagcatttttatttaatactcttgtatttaatgtgaaatgtatgtcttttgatactataataccattatcatttattacatcttgttccgttactgtcttaaattcaataggatataaaccatctattttagtacctttacgctctatataagaatagtgtttaccatataataataaatcctcaacaattctatatttatagttatatgaagtttgataactattattttcagtatttaataaatataatcttacatcatcttcaataacagtatttttaaatctatcttttatcattagttctattggtaaagctgcaatagtcccacaaatctttttcaagctttcttgtactactggtattttttcaatactatttttatttattaaaactctattactaaaaagactttcaatagttgcactataattatagtttcttacttctgtatcttttgttttattaaaaaaaaccatttttaaactcctttataaaaaaataaggagggttaacccctccattaaattactttgctgcttctcttgttgttgcttcaattactactggtgtttgaaccttagtaaaaaagccttcccaaaccttattaaatttaacttcttcgccttctggtatatagttcttatctaatattgcatcaaagtttccttttgcatctggtttagctttaccagataattttactaattgttcatcaacactatctgttttagatgcacttgaaatttcatctcttgataatatacaatcgtaaataactcttctaatcggttcttgtaaagtggtcatctcatacatgattgcaaatgatgcagcactatcattagcaccagaaacaagaaccccattaactaactttttgccagtaattaaactttctatttctggagttaaatatgctaactctatttctaattccattgatgttatactttttgagtaataatccattacatcatctgaataaaaagcattttcagatacttcatttgtagtattaaatgtttttgctccctctaatttaactggtattccatatgtataattaccttgtacatctgtaccagttatttgagcaatgtgaatatttcttaaacctactattctattagccattaaaaactttctcctttgttatataaaaataaaaaagagtaaaaaaaataagcctggtggctctctttcttactctttatgtttgtattagataattattttgttcttgttgctgcttttaatatataaactgcttgttcatttactaatgccatatctaaatacgcatcaatcataactccaacttgtccagccttagcgtaaacactatcagttaatgcagttacttgcatatcttgatttaatttaactctcatagcttccgcaacattagcaaatacaattacatcagcttctaaagtttcagtaacaactatttctttaccaaatattctgtattgtggttcttctccaactaatgaagatgctaattgaacatagtaattaccagtttcatcttttaataatgataaagcttcaaatgttgctaaattcatatataattttgctccagcaattaaagaagggtgcattttaattattaatgatttaactgtatcaattgaaaccacaccagttacaacattcttagattttaataaaccagatgtaaaactctttgcagttccatcagccttaaacatttgtttttcgcaaattcttgcatatcctttagcaagttctttaactaaaaaatctactgttatttgtggagatgataaaagtaattgcttagatactggaacacataaaccaactctttttgcatctagtataactttcttaaagtctgataaattagtatctgttaatgtgtcaacttctcctaatatttcagcttcaacattatttgtattaattaaaaattctagcttaccaggtgtattatatcttggtgcttcattaaatactggtgatattctttctaattcctcaactatttgtgttgcaatagtagttggaattgatgccccattagtttcagttgtcataactcttaattcttctgcataatctctagtttctatttgtttcttatccataataatttcccctttatctcttgtttctaatttttcaatagttgcatttaatgcagctaattctttttcatgtgcttcataagcttcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaagagttataaagcttttgttgctccataactcttaattaattttctataaataattcttgtgtatctagttctaaaatatagatacatctttctaataattcttttgagtatctaccaccatttacaaatctatcaatcgttcttattgatacacctaaatcacatgatgccatacctttaattgatgtgattggttgtttattacctggatatatatacggtttatacttttctatcattttacttttgatgtatttagtatttaatttaatcataattaactcccttcaatttatttattattgtttaagtctttaaatgacttttattctagtaaaaaaaatagaagcatttctgcttctaataaaacctatcttctccagaagataacaaagaaataattttattacccattctagggtttaactatccttatctttttaatgctgccttagttgttggaggtgattattatgagaaatggaaaaatgataaatcataataaagcagcattaaaaagatacctggcattaagcgaagaatttaatgttgaagaataacgaactcaagccaggaatggaggaatttttttgtaaagccatagccttacaagtttattgagtaatgtcgatatgtaattaacaaaaaatattagaaattagaggtatagaacaattttaagttaatagtttttcttacatttaacttcaataaagaggtaaagagtagccatctaacgactacgcttatattatataatgtacactcctaagcaaatccacaagggtattttataaaaaaataagaagggcttaacccctcctattatcttactttcctaaaacttcacaacccatttttgttacttcatagcatttatttgtttttccactaccatctttatagctgctttctatgaagtatttagctgggggcaagtttgcacctagtaaagttggaattatccctttaactttttctgttccttctatatctcttaaaatatatttatgttccttcccatcatttccgccacttctcttgaattgatagttttttgttgatttaaaatttgtaaattgttcatctgattttattattgccctcatagcaaaatattcatcaattaacttatccattacttgccatttaatttcgtttgtattatccatcattgaaactaattttgtataacctctttctgataataagaatatattattagattttgatatttgcatattagtaaaatctagttctaataattgttggtcattagatgactgactattttttaaatcaataaggtcgttttgagtaagtctagtaatatttctattaattaacttattaatatctggagtggttaccccatgtatttccgctattgtctttgctaacataactttttgattttcaccaaatccaccctctatatagatagatactctttttttgagtgtctactatatagggtccattttaaatgaatcggtctttttttttaggagaatgtaagaattttgttatgtgaataactttttataattttttaaaatctcacagaattctcacaccaataaagaaataataacactgtcctaacaagtattgacttaaaatatatatagtaactgagggagggatctatattgagacaagggacaagttataaaaatgaatatagtttaaaaacattatgtaatgaagtaagaaacttgattaatagtggagaagatgaagcttgttatgacttaattatagaagggatgatcaagtcaccacatgcacctgaaccacataaccttttgggaatattattagaaaaacgtagagagcatttattagcgatgaaacattttagagtggcgtcagatttagatccaacatatttaccagcaagatataatcttgagatatatggtggatttcattcaagtggaaagattgcatttgatgaaagtgattttaattatttagaagaaaaaaattcatataaattagaatatggtgaaaatcatattggatatatcgtaaggaggacgaaaaatgaaaattaataatattagagtaaataaaaatgtattaattataggatgtggtagacttggagcaagcattgcaaatgcgctttcagataaaaatatgaatgtaactataattgatatagagaaagattcttttagaaaactatcaccatctttttcaggaatgttaatggagggaaatggtatggatatagatattttagaagaagccaatataagaaaagcagatgtagtaaatgtagttactaataatgataatactaatattttaatttcacaaatggcaaaaagtctctttggagtagaggaagtaattattagattgtatgatcctgaaaaggaatgtgtttataaagatagtaatatacatactatttttccagcgttattatcttccactgaagttgatagaatcttaaacatataggaggatggttatgaaaaataaaatattattagttggtggatttaataaaacaagtgctttagcaaactctcttataagcaagggatattcagtaacaattattaatgaaaattatatgaattgcatgaaattagctgaaaataatcagttaaaagttattcatggggatggaacaaagccatatgtattagaagatgcagaggcttatgataatcaaatagctatagctttaacacaatatgatgagcaaaatttagtgatttgtcaattgtgtaagaagaaatttggaataagaaaaacagtagctttagtaaatgatcctaagaaaaccagttttttctataaaatgggaatagattcagtggtatgtgcgctaaacacaattacaggtattattgagcaacaagcatttatcaatgaaattgctactatattaccattaacgcaaggaaatattagtattgcagaagtaccaattttacaatctgctccaagtgttgggaaaaaaatatgggaaatagatttacctaaggaagttattataggttgtatattaagaggagagaatagtatggttccaagaggggatactgaattacttgctggagatattcttataataatatcatctaaggagaatcaaatattagcaattaaagagttaacaggaaggtaaaaaatatgaaaaatatatttataaattctagtagtgtgggtaagttgatgctaattgtaagtgggcttgttacatcccctatacttttattgttattttatccagaagatatgaaatatatttcatcatttcttatgactggcttaatttctgtaattttatcaataatagtttgtatagcaacaacaaaaaataataatgaagagcctttcactatgaagaaaggaagcatcacagttttatttatttggttatatagtttttttatagggtcattaccttttgtatttggaaaccaattaacttttatacaagcgttatttgaatctgttagtggatggactacaacaggactatcagttatggatgtaagacatgtacctaaaatatatttgttctatagaagttttatgcaatattgtggtggacttggatttgtaatggtaatggttatgttaatccaaggaaagcaagctatgagtttatacaatgcagaaggacattctgatcaattagctccgaatctaggaaaaactgcaagaacaatatttcttatgtactttggatattttttaattggaactattttttatacattttttggaatgccagtttttgatgcaattaatcatgctatgtgtgcattatcaacaggaggattttctactgaggttgatagtattggagcttacaatagtattggtattgaagcggttacaatttttttaatgattattggtacaactaactttgcagcgttattattactttcaaagagaaaaattaaacagttttttaaagtaagtgaaatgagatttttatttgtacttcttatgattacagtacctatggttgcagcatcacttttctatcaattatatatgaatataggagaagcttttagagtttctatattcaatatagtatctgctttatctacaagtggattttcaactatgagctattcagaatggccagtttttagtataggaataatgatattgttaatgattattggtggtggaataggttccacagcaggtggaatgaagcttactagggcatatttgatgtgtcgtatagtaaaagaaaatataaagaaaagaatatcaccttcaagagcagttagtaatccatattttaatagagcgcaaggtaaaacatatatcgatagagcaatggaatcagatacagtaggatttatattttgttatatatttatttttataattggaactttactggttactttaacagcgaattgttcattaagtgatgcaatgtttgaatttgcatcatcactaggaactgtaggattatctataggaataacaggcccaactactaataatgctactttaattgttgaaatgttaggtatgttgcttggaagattagagatttttattgttattataggtatatatttaagtttgaaaaaattacaaaaaataactataactaagaaataatatttttagttatattatgatgaattaataaagaaacctcacttatttgtgatacggttctccatatgacaaacaagtgaggtttttactgaaattggataattaaatataagggatatgttatttacgcgtcggctccaccatgaaatccagtagtatagaaatgtgttgaagtggattatttattatgtagttgtggactatatgcaaaatttatgtataattgaaataagaaatatgcaaaatttatttatataaatagtagataacagaaaaattgttaagagtaaggtgatttaaatgaaattagctgaagctttaaatttaagagctgacctacagaaaagaattacaaacttaagagaaagattgataaaaaatgctaaggttcaagaaggggatacaccatcagaagatcctaatatgcttttaaatgagctaaatgataatattattgaacttgaaaatattataaaattaataaataaaactaatagctctacttatatagacaatgaaagtatttcagatattatagctaaaagagatactttaggattgaaattatctattttaagaagctttattagtgaatctgccgataaaattgagagatattcaaacaaagaaataaaaattttaagtacagtgaatgtagctgaaaaacagaaggaaatagatagtctttcaaaagaatatagattaatagatactaaattgcaaggattaaattggacgaccgatattatttcttaagaatttagatggtaatttgcaagggtgaacataagctctactaattgaggtgtaaattagtactatgatagcatgtacggaacaatgtgcaaataataaaaattaagttcagtaatgttacaagagtaaagttataaattaatgtaacgaccgtatgttggcttgtgaatgagggtgggatagggattaatatatagttatataaaagttaataaaaataaatatacattataatttggaaaatttttaagaagaaataaaaagcattacttgttattgtcacagacaatcgtaccataagtaagagatgtttattatttattatagccttaggtgttgaaataatttgactaaggctatttttatgaatatatatttatattatttttgaattaaaactttttctatttgtccgagaaaaatagtatgaaaaagaaagatcaatattatataattcttagtgaaaattttataatattttgatatgtaattgatgaacatactaatgaaaagatgtatataagaggtgtataaaatgaacaaattaaaattagtagtagtcatgataataatttctattagtttagtagcatgtaataattcagatgtatcaaatcaaagtgaaataaactcaggtataacaaataatggaatagctaatactaataagataacaattgatcaggctaaagaaatagctttaaagcatgcagaattaacagaagatcaagtttcatttgttaaaactaaaagcgaatttgacgatggggtagaaaagtataatataaaattctactataataataaggaatatgattatgaaattaatgtagctaacggagaaataattaaatacgaattagatgacaagagtaatgaaaatagtagtctaaataattcaaatagcacagctaatatttcagaagaacaagcaaaagaaattgcattaaagcatgcaaacttaacgagtgatcaagttacatttgcaaaagtaaaattagattttgataatggaatacaaaagtatgaagtagaattctattataacaataaagaatataattacgaaatagatgctaatactgcagaaatattagcttatgaacaggaataatatattgagaaaagatgccactctttagggagataggcatcttttttataagaattaaaatgatataatttaagcttaaaaaatagtattgactctgacgttgcgtaataaattaaaattatatttgtagttaagataaataaaataatttatgaagggaggcatataaaattagtgagaataagtgaagtggcaaagctaacaggaataactgtaagaacattacactattatgatgagatagggctgttaaagccaaataaaataacagaggctggttataggttatactctaaggaagatcttgaaatattacaacaaatactgttttttagagaattggattttccgctaagtgaaataaaggaaataatgaataatcctaattatgataaagaagaagcacttaaaaaacaaaaagaattactaattcagcaaggacaaaggatagatggactaataaaattaatagataaaagaatagaaggggataataatatgagttttaaggaatttgatatgaatgaaatagaagaaaataaaaagaaatatgctaaagaggtaaaagaacgttggggaaatactaaagcatataaagaaagtgaaaagaaaataagtggatacaataaagaaaaatggggagacattaatcaagaaacaaatgagatatttaaagcatttgctaaattaagggattgtgatccaggaagcgaaggggtacaagaattagttagaacatggcaaaagtatattactgataatttctatacttgtacaaatgaaatattagctggattaggtttaatgtatgtgcaggatgaaagatttaaagaaaatcttgataagaatggtgaaggaactgctaaattaatggcggaagcaatagaaatttattgttcaaaataatatgacacctaaatgacacaaaggaggattattataaacacataaagtagttaatgcaaagtaattaatgattaataataatcctccttttgaaatataaaggccgcctaacatgagagtcccccttaagtgttaggcttttttcatgtaaaaaatcaaaatatgaattttattctaatttaaatgtaaaaatgataaatttaataaataagaaagaaaacaatataaataggaatataaaaattgattatgtatatccatttatgaagaattctgatatgagtagcattctttattatatccgattcaatcagaatcaataaataagataataccatcagctcaaagagcaacaataatttcaatagatagtataattttttcagtaggtattgtatgtatttttctaatattcggagttacagcagatacattaggtttacaaatgacatttttagatttaggcattttgcagataataatagtaataattcttaataatagaagtaagtaaattaaagaaattgtgcagaattgacaaaggtttgtcaataaaagaatagtatgatagtatatattaatgcataggatactaatatgtacttagaataatgagatagcaatggaggaaatgaagttatgttaccaaactgtccaaaatgtaattcagaatatacttatgaagatggaagtcttttaatttgcccagaatgtggtcatgaatggactgcggcaagtcaagctgctgaagaggaagcaagtattataaaagatgctaacggaaatgttttaaatgatggtgatactgttacaataattaaagatttaaaggttaaaggtgctacatcagcattaaagcaaggaacaaaagttaagaatattcgtctactttatgatgtaacagatggtcatgatatagactgtaaaatagatggatttggagcaatgaagcttaaatcatcagtagttaaaaagatataaataaaagcaatatatgtaagggctgtttataataaaattaagcagtcctttttatttgagataatgttatatgatataattaaaataaaaaaataagcgtttggaggcgatagtttatgtttactaaagaagagcttttagtaatagaggatgcattaaaaatagctgatgaaaagtacataaaattgcttgatgaaagcaaaaataataaaaataaaatggttgcatttaatagaaaacaaaagaaattatggttagttcaaaataagttaaataaaatattaaaagaagaaatttaaaaatgttatttttatagtatctagtataaaaactagatactttttttattaataatttgctttatagacgatattaaattaaatattcaatatatcaattttaattcatctataaatattgatatatatcacttaatttattaatttatcacagtgtatttaatagatatatatacttctatttatattaaattgatattaattacacatggagataaaataacacaaacaataactaaaattagtaaaatgttgatttatttaacataatgtagtattttgatattttttgaaaaaaatcaataataatacatataatattttgtaaaaaaaatgtatctacctctgtttttatataaattttataaaaaatataaatgatgaagtcatgaagtttatagatgatgaatgtgaaaattatgaaattaataatgaagaaataaggaacaaatatatatcaattttagaagagttagaaaatagatattaataataataatataaaaaattggaggtataagaagtgataaataaagataatacaattggtgaaatattagaaattaatccaaaggcagctgatattttaagtgggtttggaatgggatgtttagggtgtccatctgcaacaatggaaactttagagcaagcttgttatattcatggtttagatttagaagaagtaatgaataaactaaatgaaaaataatttataaaaattagatatagctagaagcttagtggatataatttctattatgtttatagctattttttagactaaaaattgtaggtaagggaaacctataaaagtattaaataaaagatattttatgtagaaaggaaggtattattttatgaaagctcgtgtaaatgaagatacttgtattggatgtgaagtatgtgtttcagtctgttcagatgtatttagcatggatgacaatggaaaatcagttgctataacaggagatattccaagtgatttagaagatgatgcaatagaagcaagagatgcttgcccagtttctgctattgatattgatgaataaaatgataaaataatagcattgaaaaatacttaaatgatagtaagatatcatttaagtattttttttataattataaagaaatactagttagtataaaaatagatataagaattatagagaaagggtgagtatatggaaatatatactataggacattcgaattatacagtagaaagacttattgatatgttaagatactataatattaattgtgttgttgatattagaggtacaccttattcaaagtataacattcaatttgataaagatactattaagtatacattaactaaagcaggttttgtttatatttatatgggagaagaattagcagctaaaaggataagaaagatttcgtataatagtgaaggatattcagattttaaagcagtaataaatgaagaggaattcataagaggaattgaaagattgagagttggttatagtaaggggtataaaatagttttattaggagcaatgcagaatccgataagatgtcatagaagtatattagttggtagatatttaagagacaaccatattaatgttaaacatatattggatgattattccattgcaagtcaagaagaaatagaggaaatgcttttagataagtattttagtaatagagggcaattaacaatagatgatttaataggaaatggtttaagtaatgaacaaatgattgaacaaggatatgaattagctaataaggagattggatatagaattgagaatttaaaggaataataaggtatttaaagaaagtacaaattatttatcattagaatatagaaaattatataagtaaaaattaattatatattagaatattgttgaaggtataataaagtactggttagatataataatttctaaaactattggaaatactaattattgattagtattgcacaaagtagatagattcataatttaaagttacttaaaaaaagatggattatataatccaccttttttatttactcagctatttcatttgtaaatagtctttttaaaatttatattttttattatacggctaattgtgcggcatgcagcttatttaatgatttaaattctttaaatattaaaagtgctgtgatgacaacagataagaaatcagcacaagctccagcagcccagacaccatctaatcctatgaataaaggtagaattagcgtaaatggaattaataatattacttgtctaagcaaactaacaaacatagacattttagccttaccaatagattggaagtagctagttgcaacaatgttaattccaactataggcatcattaataagtacattttaaccccttttatagcaacagctgtaagatcaggatcattattaaacaagcttattgcaaattgagggaatagttgtatcaatataccccctattgtacaaataacagtagctgcaatagtagcaattataaatgtctttttagccctatcatattttttagcaccatagttaaaacctataattggttgacaaccttgattaataccaaagataggcatcataaataccatattaattgatcctattatagtcatggcacctatagacaaatcattaccataagcttttaaagaattattagcgacaacttgcactaaactgttagcaatttgagttgcaaaaggggctataccaattgcaaaagtcatcattactaagtttttctttaatttcatattttcaacttttaattttagattagaatttcctttagtataataataaagtattataaagaatgtaagtgcttgagaaataacagttgcaaaggcagcacccttaattcctatatttaatacaaaaacaaataagtaatctaaaactatattagtgccacatccaacaatcatagttaatgaagcaagtttaggattaccgtcagctcttacagtactatttaatgcaaaagaaaggatattaaaagtacaaccacataaaattacagtaatatattctttggcataaaataaagtattttcacttgctccaaaaatatttagtattgggtttaagaaaataagcccaataacagtaattataataccaactattaaacttaaggttagtgcgctaccaattagtttttcagcctcatctcgtttgccacgtccaagatttaatgaaatatttgcagttgatccaattcctataagcatgccaaaagctaaaagaattgacattataggcatagttattcctactcctgttagtgcaagggagccaacatcaggaatacgtcctataaacattctatctacgatattatataaagcattaaccatcattcctattattgctggaatagaatattttaataataattttccgatagattcttcacctaagtgattttgatgtcccatatttttgtcctcctagtataattaattattgtttgttatattttttgaaatcttatttagaatacttaagcttgttgaaatttcttcaggacttagtttattggtaagcatgttttcccatttggttaaaacagaaaagaattcatttttaatattaagtgcttttgaagttaaataaattctatttattctcttatccgttgaatccttagaacgagttataaagcctaattcttctaatttctttactgctttagcagtagtacctttgtctatattaagcaattcagaaagtttttcttgactgattccatcatttttatataaatgaatcatgaacatatattgtccactaccaaatccaaatttactaaattcctttgtgaaaaatacattagcttgtctatgaattaaagaaatatatttacctaaatattcattattacagctcatttaaataagtcctttctaattaaatttttttaaattaataagattatattttacttatatattataaaaccaataaagttgcaaacgcaactaaaatttaaatatataaaaaatagtacttgtgtaaaaataagataaagtgaatgaaatgatgagcgaagttgaaagaaaatgaaagaaaatgaaagaaaatgattgacttattaaatgaaaaaagttattattgagataaggaagtgatgtaaatgttatcagaagaaagacacaaattaattttagataaattagaaaaagaatcagtagtttatttaaatgatttagttgaatatttaaatacatctgaatcgacgataagaagagatttagtagctttagataaggctggattattaaagaaggttcacggaggagctacatcaataaaagaaataagtataacaactatagatgatagagttgagaatagacaaaatttaaatataaatgaaaaaataaaaatagcagaatatgcagcatcgctaattaaagataatgattttgtatatattgatgcaggaactactactgaactaatgataaatttcattaacaatacaaatgccgtttttgtaacaaatggaattgtacatgcgaagaagcttattcaaaaaagatgtacgacttatatattaggtggagagcttaagcttacaactgaagctatagtaggagctgaaacagttaatgcattaagaaaatataattttactaaaggctttttcggagtaaatggagtagatattgaaagaggatttacgactcctgatataaaagaagcaatggtaaaaagtgaagcattgcataggagtaaaaaaagatatatactatgcgataattctaagtttggagaagtgagttctgtgacttttgcagatattaaagaagctaaaataataactacagttttagagaataatagatatagacaagaaactgaaattttggaggtagaaaaataatgatatatactattacatttaacccagcattagattatatagtaaaaatggacgattttaatttagggcatgttaatagaagtgtttgtgagaatgtttatgcagggggtaaaggaattaatgtttctattgtcttaaataatttaggagttaaaagtaaagctttaggatttattgctggatttacaggtgaagaaatcgaaagagaagtaagagaatttggctgtgatacagattttattaaattaaaaaatggaatgtctagaataaatgttaagataaaggctgatgttgaaagtgaaataaatggtggaggaccagaaatttcagatgaagcattacatgagctttatggaaagatagataaattatcagaaggagatattttagtattagctggtagtatcccaaaaacaatgccagtagatatttatgaaagaataatggaatctcttcaaggtaaaggagttaaatttattgtagatacaactggagaatcgttattaaaggttttaaaatataaaccatttttaataaaaccaaatcatcatgaacttggggatttatttaatgtaaaacttaaggaaaatgatgaaattatagaatatgctaagaaacttaaagacatgggagcaagaaatgtacttatatctatggctggtgatggagcaattctaattaaagaaaatggggatgttattacaagtaatgttccaaaaggtgaagttaaaaattctgttggagctggtgattcaatggtagcaggatttattgcaggatatttagaagcaaatagcgtagaacaaggatttaaattaggagtagcaacaggaagtgcttctgctttttcagaaggtttagcaacaaaagattatgtttgtgaattattaagtcaaattaattaaattcgagggaggactggaaagtgaaaataacagatttattaaaaaagaatggtatagcacttaatcctgaagtgaagacaaaggaagaagcaattaataagcttgttgatttaatgaatgaaacaggaagattaagtaataaggaagcttataaagaagcagtgttagcaagagaaggcttaagtacaacaggtataggagataatatagcaattcctcatgctaagacaactgcagtaaaggaagctggtcttagtgcaatggtacttactaatgggattgattatgattcattagatggagagccagcaaagttattcttcatgattgctgcaccagaaggtgaaaataatcttcatttagatgtattagcaagattatccatgatgttgatggatcctgaatttaaggataaattaattaatgctaagagtgttaatgaattcttagaacttattgattctaaagaaaatgataaattaaaggctgaaagtgataaggaagaagctcaaaaaggacaaagtaatggatatagagtattagcagttacagcatgtcctacagggattgctcatacatttatggcagcagaggctttagaaaataaagctaaagacatgggaattacaataaaggttgaaactaatggttcaggtggagctaaaaatgttttaactgatgaagaaatagctaatgcagattgtataatagttgcagctgataaaaaggttgaaatggctagatttgaaggaaagaaggttattcaaactaaggttgcaaatggaattcataaaacagaagagctattaactagagctactaatggggatgctccagtataccatcatgcaggtggaagtgatagcgaaggagcatcatcagatgaaggagaaagctttggaagacaaatatataaacacttaatgaatggtgtatctcatatgttaccatttgttattggtggaggtatattaatagctatagcattcttattagatgattacaatattaatccagcaaactttggtaagaatacaccaatggcggcatttataaaaactataggtgaaacatcatttggatttatgttaccagtacttgcaggatatatttcaatgagtattgcagatagaccaggtcttgcagttggttttgttggtggtatgttagctaacttaggtacaacttacgcaagtgcatttgattcttcagtatctgttattagcggaggattcttaggagcattatttgcaggttttgttggtggttacttagtattaggattaaagaagatatttgataaattaccacaagctttagaaggtttaaaaccaacattattatatccactaatcggtataggtttaatgggagcaatcatgatattcgtaaatccattctttggtggaataaatgaagcaatcacacatttccttaactcaatgggtggaacaagtaaagtattattaggaattattgttgcaggtatgatgtcaattgatatgggtggtcctttcaataaagcagcatatgtatttggtacagcatcacttgcatctggaaactatgaagtaatggcagctgtaatggctggtggtatggttccaccacttgctatagctttagcatcaacattctttaagaataagtttactaagagagaaagacaatcagctcttacaaactatattatgggattatcattcataacagaaggagcaattccttttgcggcagccgatccattaagagttataccttcatgtgtagtaggttctgcaacagctggagcacttacaatgttatttaactgtgaattaagagctcctcatggtggaatattcgtattacctgtaatcggaaatccatttggattcttagcagctgttgttattggttctgtagtaggaatggcaatgttagcagtattaaagaaaaaggtagtagaataattttaaaaggggctgtatcagattgaattaataaattcaatctgaatacaactcctttttttttaattcattatttttccatatgaataaaaagtgagtattatcgaaaaaattttgttaatactcacttttactttaaaagcaatagtaatctatttctttaatacaacactaaaaaaaacctgtattctttgatttatttgatgaagatttaacaagagttgtcgaggggattcatttaatctatttaacacaaccgaaaatacttttaaatatattggtgaaataaaaactttttttgtaggtttgaacggtagaacaaatactgatttagattctgagttttatatttatattaccgacgttataaatattaaaggaagatataactatgttaatcatgaagcgtttaacactttcaaaaacaatatgttggatataaataatgatatgataaaaaatataaatgttttaaataatagtgttgatattgttgataagggtgtaactgttaatttttcagattttgttaatgaagacctaagagattcagaaattattaataatattttaagttttacaagcgcatttgagaaaagaactattgtaattgatgaagatatatttatcgataaagctattttgctgccaagtaacacaacggtaataattaataattgcactataaaacaaaatgatgaagtctttgataatgtgtttagaggggataatatgaaattaagcacatgggatttatattatgttccttctgaaatagagtataataataatattaaaattctagggaaaggaaatgcaagaattgaggggtgtacagtaaataaaaaaacacacagataatacaacaatgacaggcgacaaatggggtggaagaactcacatggtaaatattagttgtactaacggttttgaattaagtggcatagaatttactaaaactcgtgggtggtgtatagaactagagtttgttagaaacttttatgtacatgatttagttattaatagctaatgggtaaaaaatggtgacggtgttaatataagagctggttgtcaaaacggcatggttgaaagaataagtggagcaacaggggatgacacaatagctattaatagtcatattagaaatgatttaagctatccaatcaatgataattttatgtatccaaacgaattcacatataaatataatattgaagggcgtaaattagaccctaattttagtgaaattaaaaatatttcaattaaagatatatctaaagtaggaggtcaatatcatgtggctataatactttcaatgtttggtcataaaatatctaatatatcttttgataattttaaaattagcggagatattgttttaccttggactaactcatatatatctttttataattatataccatcagatgtccctaagggtgattctgtaacaaaacctactgaaagtgactttacaaaaggtgatattacaaatataagatttaataatatagagtgtaattgtattactgatggaatggttttgtatagtaatttagaagtagacaacacagggggtaataaaatagtacaaaaaaatacaaatgcattgataactaatataaatcaagatggatttacattaacaaattcaaaaataggaatataattaaaatttgtgatattaaacaaaatatggtataattctacagaaagtgaggttgtaaaaatgaaagataaaagtattcaatgtctaagagcgctgtcaatattagctgttgttcttattcattctttaccaaatgcagattcttcaatctatgtgaggcaattcataaacttttgtgtagccatgtttatatttatatcaggttatttaacagatataaatatagatgatactaaaaagttctataaaaaaagaattttaagagttatatttccatatttaatttggtctgctatatttatagttaaaagtaaggattataatataatatctataatatggagaattttaacagggcaagggtgcaatatatattattatatcatagtatatatgcaattaattattgtaactccactatttggaaaggcattaaaaagtaaatatagtaaaataccttatttattaacaccaatatcattgattttaatttatatttatatttttattggaaatccaataccttttccttataatgttttaagctttacagtatggagcttattttattattatggtttacagttaaaatatcttaataaaaatctagaaattagtctaaataaaaatttaataatgtatattatttggttaatattatctataatagaaggaatattatggaataagcatggtaattactctatggctattagtcaaattaagataagttcaatactatgctccttatattttataaaggtagttatggttattaaaaataaaattataactaataaagcaattattatgttgggagactattcatttggagtatatctaactcacatgttttttatagatattttaaagaaatttataccaaattatagtgtattttttgctttaataattgtagtaattgtattattgttaaactgtatatttatatatattggaaagttaatattaaaggataaaagtaaatacttagggtttatataattagttcgcaattgataaaaattgttcgtaaaactaaatgaaaaataagttagaagttagagtaaaatctagcttcttttttaatacaaaaattgatagattattaaaatttggaaagttgtcaatacttataagtatatttttaataataagtattttcaacatatataaacatagaattagattattgaaaagttgaataaaatgaatagtattgataaaattggtattgtaaacttaaaagtatatttaaaagaacatttagatgggagaaaatcaatgaaaattaataaaatatcaattgatggtgttggaggaataagaaatctaaatataaactttaatgaaggattgaatttaatctgtgggcctaatggaataggaaaaacaacaatacttgaaagtatattcgctccttttgtgccaagtatgtcagatatacctggattaaaaagaaatgcattatctgaaaaaggagtaattgacgtaagtattgtaagtgatgaatcaattaaaaacgctaaaatcacaataaatggcattgatcctaatagtgttactggagggtctatatggaataaactatgtaaggacattatatttttcaaaacacatagagatataaactatatatctgttgatagtataaaaaaggacgctaaaaatagtgattatactatagctaacactcaagtaaaaagtggcgtttcatctagtgatataaagcaatggtttataaatagatttatgtggagcgctcattgtaacggtctttcatatgctcaaaagaaaaattttgaattagcaaaatcatgttttagtattttagatgaagatataaaattttgtaaagttactcctactacttatgatataaaactaaatacaagagaaggcgaaatatattatgagtatttatcatcggggtataaatcagttttacatttattgttaggatttataaaagaaatagagtatagattcggagataataatatacttgctgaggattttgatggtgtaattttaattgatgaaatagacttgcatttgcatccagagtggcaagcaaaattaattatagcattaaaaaggatgctacctaaagcacaaataatcgcaacaacacatagtccacatatgatacaagcagttttaccaaaagaaataattccattggctgtaaatgagaatggtgaaatctataaaaaagatttaactcttagcaagtatggattacaaggttggacaatagaagaaatactagttgatgttatgggattaaaagatacttcatctgatttatataaaaatacaataaaagaattcgatattgcaatggataatgatgatattgaaaaaattaaagagacatataaaatgttacaagaaatgttgcatcctaataatcaattacgaaaaattttagaaatacaaacagcaggtcttagagaatgataaagctaaaacgaccagataaacctatagagttaacagatgaagttaaagaaagacttactaatgaattcaaagatactggaaaatcagtttggagagaaaaatatatagttgatgcattaaatcatatgtcaaataataaatgttgcttttgtgaaactaaacttaatatagaaggaaaagctatgcaagtagagcattttcatcacaaatcgaaatatccagatgaagttgtagaatgggataatttattaccttcatgtggaagatgtaatactaataaaggaacacatgacactaaagaagaacctattattaatccaactatacaagaacctaaggagtatttgtatttaaaaaattatacaataaaaagtaaaaataaatgcaaattaggtttggatacaataagagtactatatcttaatgatagtactggattagtacaagctagatttaggatatgtgaagctattagatgtaaaatagaagatatagaagagttgttgagtacgtgtgggcaatctcaagaaattcccactagaaggaaaaataaaatagtaaatggaataaaagatattttaagatgtgcacagccaagtgaggaatatagcgctgttgtagctaatgctataataaaggatgaaacatatcaagatataaagaaaaaattaattgaattagtgttttgggattcggaattagaagaattggaaaaggttagtatagaaataatgtttgattctgaataaagatattattataaaaacttaaaaattctatttaaaataaaagagcttaggaaactattttagtgttgcatctaagtaaaacttacttgttgacacgaacgcactaggtctataaatgatgaagtcatgaagtttatagatgatgaatgtgaaaattatgaaattaacaatgaagaaataaagaacaaatatatatcaattttagaagagttagaaaatagatattaaggagttgctattatatgaatattattaagttaaataatatagaagataaaagaaaaattaagaaaacaagtaagaaaaattaaaaatgatacagatcatgctacttataacttaattgaaacaaaggttgatacggtaaaagataaaaagtggaataatgtatgataaaaatcttgatccagatatacgttattttatttattatatatctttgtttttatttacaccaaataaggttaataatatacaattatattatttgtatactttatttataatatattaaaaatttaaacgttttaatataaggcatttaccattttagtgataatatgttataatatgtaatgtaatctttatttaatctgttaagatgatatgaaaaagtagcttgattttttatagaattattcactctttgaaaattatataagtttgaatattttattgtatagcaaacaaacctgcaataaaattaatttttgcaggttaaataaaggtattaagtttaattaagctgatggaaaccaagagtttttatctgagatatcgctagggaagccggaaacttctgatggagcacagttatttaatgagtcatgtggtctaataaaattatagtgaaagataaataaatatattaagttatttttgtatcactagacataggtgctatagaacgtgtttggtattaggtaataccgtagcggtagcttcgttatacggaggtaatctatcggttagaaagtaaggttggttaaccacaatttttagcttcatttattagtgtataatctgaatcagaacttctagacttagttaggtaaaatgccagaataaatctagtttcagaatcaatagctaatcatagacagtatctttcatcatgaataaatactactgtttcatcagcgtgccaatggtcagattgtaagcttagactatctttaaatttatcagccttttgtttaagaatggtgcaaatttattggtccaacttactataggaatatgggataccttaataccagagttaatcatcaagaattgagaaatagatcttgttgatgaattatttaaaaaatatagtgttaatgtagttaatattacatgcatcagaaaacgtattcatttaatagggagagaacagttaattaattcactagatgctatatcaatatttgtgtatgatgcctaactattatgtgattacactttttgttattgcatttataacgagtttaatatttatatgagtaaggtaaatatattcctttatcacatttaggacatctaggataatttctttaaggtaatcctttaccgtcgccaagtgtgaactggagcctaaattgattacattgatacttttgtttagcgtacttattcaaacccaatttatatagtttatcagaatgacagcgtgaagattttatattagtcttgttcattgttcttatctccttcataaggaggtattatttagttttgcaaaactattgtatttctttagggggaggagagcaatgtttatatagcttaacagagcatttatttatacaaggaggtatatatgaaaaaaatatgtaaaaatatcactattttatcaataataattttttctctaatatttaatggtaatattacatttgcatatactcaaagtagtaataatgactctcaaaacatagcagtattcgataaaaataataatatatggaaatctaaattttttagaatccctagtttacaaatattatctgatggaactatattagcattctctgatattagatataatggaagtgacgatcacggatttatcgatataggacaagcaagaagtatagatggtgggaaaacatgggattatgaaatagtaatggaaaatgaccgtaaagatgaaacatattctcgtgtcatggattctacaactgtagttacagatacgggaagaattatattaattgctggatcatggaataaaaatggtaactgggctagtagtaccacaagcctaagagaagattggtctgttcaaatggtttattcagatgataatggagtaacttggtctgataaaatcgacttaacaacaaataatgcgcgaataaaaaatcaacctagtaatacaattggatggttaggtggtgttggaacaggaattactatgtcagatggaacaatagtagtacctgcgcaaattgcattaagagagggtaacagtaacaattactattcaacaattatttactcaaaagataatggagagacatggacactaggaaataaagttcctgattcaaagacttctgaaaatatggttatagagttagatggagctttaataatgagctctagagatgatgtacatggttatagagcatcttatatatcatatgatttaggaaactcatgggatgtatatgaacctttacatggaaaaatttcaagtggtaaagggtcaggatgtcaaggatcattcattaaaattactgcatcaaacgggcatagaattggattaatttcagcacctaaaaatacgctaggtggatatactagggataatattaccgtttacatgatagattttgatgatttatctaaaggtattaaggaactaggtgtgccatatccttacgctggaaataaaagtggaggaggatattcttcattatcctttaataataatactttaggaatacttcatgaagctgatggggatatatggtatcaagatataacagactatttagatttagttaatggtaataatacaaatgtagctaataaatctaaattaaagatagttgttaatgatggaggaaatggaaattcaggagactggggtgttctggctgatgctagattcatacgttaatcatttaaattaaaggtaagctaaaagatatagaaaaagaggagctgtatcagattgaatttattaactcaatctgatacagttcctttcttttattgaatccagttatggtaatagtaaaatcttaattagtaggattagtattatcgaattcataagccaatactagaaatagttttgtctatccaattagcctctgctacaatagtatttaattcgtcatttgcatccgtatatttaaattcatggttaccatttttattaaacaaaagctcagtttcatttgtttcacattcactaggtaaaactaacttagcagtaacatttccatttgttttatcttctgtagaatattctatcttaacataagctttatattctttagtagtgtattcataaaagtttaacatcttactacttataaatttatttttctcactttcactattaccatatgtttcagtagcaactagttttaagtatttagctttaagtgattcaggtaattgtatagattgtaagcacttaaataatcagatgaaccttctgttttcattgataattcatagtttgctaaccactcaatctcgtcatcattcattctagtatctactgcctatttcatcaatggtataggtaactttttgaactgttcagaattctattttccataagtggtagtgtctttcaatgttttttggaactattactacttgtttgacaatatattcaattatattttcaggtatatatttaaagctattatataaccagtcaggataactaaataatactacttgtattgcaaatcctgagttattttcttcttttctatgtttcataagagtatatcctattgatactttacaataaacattatagaatctacttttgtcaactcccataagacttgtttcagaataggagtgaaaaaagaagtgaaattaggctatgtaagagtaagttttcaagatcaaaatgaagaaatacaaattagacaattaaatgaagttggagtggattttattcacaagggaaaagtttcaggagcaacaattaatagagagaaactaaatgaaatgattaataattatttgcgtacctttattagatagataagataaaataagataagatgcgaatttaaattataaatttaaattatttttaaatatgtagcatttgttacgaaataaaatagtaatttactgtatagtaataatataagttaaagcaatatcgagaaagatatgaaaggagtacagtaaatgaatgctatagaaataatgaatgaagaacataagtatattcttagaatgctacaagtaataagaaaatgctgttttaaaatattaaataacgaagaagtcatatatgaagattttgataatataatagattttattagaaattatgcggataatcatcatcataaaaaagaagagaaaatactttttattaaaatggtagaggagctaggagaggcagcagaaaaggttgttaatcatgggatgcttgtagagcatgatttaggaagattacatgttagggagttagtttctgctttagaaaaagtaaaagttggagaggaagaagcaaagctagatgtcatagcaaatgcaatctcatatacacatactctcaaaagaattgctggtttactttaactatattctgttcaattttcaaagaccatttactctgtcacaccgaagcgacttctttatcttatcactacttacgacatctgtcaataacttttttaaaagtttttgtcgtattttgaaagcgacaattggtatcttatcactttagcaattacttgtcaataacttattttttataagtttttgtagtattttgtcatcagcgacgtattttatcttatcattatatattacttatgtcaacaactttcttttaattaaataatactttatttaattagaagaaagtgagttgaatactttatttagattttatattccctagtaggtttaatatctacaatatactattcactcacttaacttattttgaaaatacaagtttcccttatacttctatctattgaatattgtttttatagaatctaataagctctgttttgatactcctttatcattatctatattacgtgttaaatccattataggtttaattttatatattgtatctttatatcctttagatattctttttctaattacatctgtattaaaatccatcattccctttaagtctgcaccttcaccttcttctgaattaatctgtattatattagtattaggatacatctctgtatttatctgactatctgctgataattgaactactattataatatcacaatgttctccatatacaggttgtattggtacattatcaacaattcccccatctaagtaattaatattatctattagaggagaatcatatattaatggaactgctgatgttgcatataatatttgttttataatatcttctgaatattcattaatattaaagtattgtgctcttatttctggaatactcgtacatgttgcaaatccctttaccttagaattcttaatcttcttaaaatcaaccttttttaatatatcattcaatccctctctcgataaggtcccccccttaacaacagtaggtatatatttttttataaatgacatatttttggcccctaaaaaaaataatattccttttacaattaaatctttttcttctaatggtagaatttcttctcttgttaagctacaccaaatttcttcagctaaattcaagtttccctgtaaaaacaacatagcatttaatgctcctatagaagttccagaaacaacttctatatatttatctatgtttaattcagatagagccttccaaactcctatttgataagctcctcttgaaccccctccagctaaaactaatcctaccttcatactctcctcccaattacttatcacaccctaaagctttaataattataagtgcagtatcttctatagccctttgagtaacatctatggtcttacaacctaactttctaataattttatctgaaaaatcaaactcctctattattctagcatcacctgcatattcaatattagaaggtattctatggaacttatctaatcttcgctttctaatttctattaattgcaatggatttattgttaagccaaatattttatgtttatctatttcaaataattcttttggcacttctacttctggaactaaaggaatattaatggccttaattcctttattagctaaatacatgcataatggtgttttagaagttctagataatccaactaaaacaacatctgcattttttaatcctctataatctttgctatcatcatactgcatagcaaactccattgcttcaattcttttaaaatatgcttcatctgttttccacatagctcctggattatattgtggttgctcatttaaaattgatgatgcaacattaattataggccctaatacatttataattgatacattactttctatacattgttgagttaaatactctcttacatttacagtaataatagttgatacaatcattgtattttcacaggctttaatatcactcataagttcttgtacatcctctaaactcttaacataaggaattcttcgcacttcaacattttccgaaaactggcttgctgcagcctgtgctacctgttccgctgtttctcctattgaatctgatactgcaaaaattgttagcatatctaataccctcctatttctctcaattaaactaaattctcttacacttattattataccaacttttttcaaataattgctaatatgatgaattataatatctattatgataaaatcaaagtatacttaatctaactttaggaggagcttatgaaaaattcgcttaataaagataaaataattacaattggattattgccaattatgtggctggtatatttcttatttgaaatagttagtggtagagtcaaagacttttatactcttatactgaacctttctttacttttagtatttgcactggttggattaattatctataagtgtagtactaaaaatataaatggcttgaataataaatcattacttattactttcttaattttaatgctcttagatcagggtcttaaagtaattattaaaactaatttctttcattcttattttgaaataattccagattttctttcatttaatcctataataaatactcaaggctcttggctaaatgctagattcaattttaatattggattttcattattaatcttaatcaatggaatagctctattgctatttattgagttatatagatacgtaaaatataaaggtcagaaaaacttttggatagatatgtgcttcatctttatctttgcaggagctttatgttcatttatagataaagtattttacggtggtagcctagacttcataggaataagtgatttgtttattgctgatttcaaagatatatatataaacttaggtttgctattttttattatgtcttgttataaaaatggtttcttttctgaaacagaagaaacatcttttaaagatgatttgaattctataaagaaatttattatattcataaaaaaagatttattaagtatattaaaaaaggaaaaggtataaataccttttcctttttatatatatattattatgctaagcaagtttcttattaaaaaatcacttctataatagaagtgatttttggtggcttaccggggaatcgaaccccggacaccttgattaaaagtcaagtgctctaccgactgagctagtaaaccaactctcaaaagaattgctggtttactttaactatattctgttcaattttcaaagaccatttactctgtcgcaccgaagcgacttacttatcttatcatctgttacgattcatgtcaatactttttttaaaagtttttgttatgtttcgtaatcgacaaggattatcttatcacttcaaaagttgattgtcaacaacttattttataagttatttaaccacttaatcatcagcgacgtgttttatcttaacactattagctaaactcgtcaatagatttatataaattttctacaattttttttatatcctttccttcagcactttctaatatccttactggtcttccccctaataaatacaaaacatctgataaccttattatttcatctatattatgtgttactaatataatagtagcattaattttatttcttaattccattattagatcaaccattttgtatttacttttaatatctaaagacttaaaaggttcatccaataatattatttctggatttcctattagcgcccgtgcaaaatttattctttgcctcattccaccacttagttcattaggataactatttttaaattctattaatccaacatcacttaaaactttatctacttctttttctattttatctttttcaaagtactgtttcgcaataattcttaagtttccatatacactttcccaaggaattaaattatcattttgaaaaacaaaagctatttttttatcttcaatataatatttttgggaaatataatttaataatgttgttttaccacaccctgattttccaataatgcagtttatctttcccctttttaattctatattaaaatttttatatatttcattgttatcatatttaaaatttatattttttattatcattattaccgcccctattaaaactcttatccatcataaagtcaaaaatataaactatgaatgctattataatcatccatgcaataaccccagcagtattcaattgtatcttttcaaattgtatattagatcctatcccatattgtggctgagaatatacttcaccagatattaccactttaaatattaaagatattgttgaagttaatatctttttaatttgtatccaaattacaggtattattataactcttagtttatcaatccttgatactctatagactgtgaccatatgtaataatccctcatcaatattaagtaatgaattcaaagttgcttcataaaaaattggaaatgaaattactatacctattatcgttggtgcaaaatctttagaagtccatattaataatagtactataaatgccatagttggtattgcttttaaaaatactgttattggatataaaaaattatatatcaacttactaaaataactactaacccctaaaattaccgaagctattatagatactataaagctttttatacatcttaacatgctattaagtattaacaataaaaatttatcttttaatattattctatacatctcctttaaaacatcaaaaaaggaaggcaaaagtagcctattattaaaaataatagctactacttgccaaataaatataattacggcaatagaaatcattaaatactttttatttcttaatgaatattgcgtcatatcctccattatctcctttattattttcatctataatagaaaaataagtttcatattcttgttcacaattttctattcttgtgaaggctaaattactattttttaatgcttcatcaataacatctctatttacagttatacctagcttttcacactgctctgctgctaattgagaattatttattgcccactcctcagcatcaataaatttgtctataatttcatcatataatcctgaatcttttattttattatagaactcttctttaattaataatgttgattgtggatatccattttcaacatcatatatttttttccattcatcatttaagctacatattatttttatattctcatttttagccattacagttgataatactggctctggtaatactgcataattagcttgaccacttataactaatggcgcaagctcagatgctgctccaacatatgaaaaagtaatattattttcattaacattattattatctaatatatttttaaacactatatcaggtgtaagccccttacctgtattatatatttcgcacccttccaaatctaataaactatctacttcttctgttgatactaaatataatgaaccccatccaactgttcctgcaatcttataacccaagtcttttttataagcttgtaatgccaagtttgaaggcactatcgctaaatcagactcccccttcattaactctgataaaagcgtatctgttgtcttttctattgaataatttatactaatctctttatcattttcttcatcagatatcaaattacttattgctatagctggtagtccatccgggcatattaatgtggcatttatattttcattagtgattttattatctttttggctacatgatattaatagtactgaaaatattgctattgatataatacttaagatttttttcattttaatcacctcacactaaattttaccatattattacatacccttccatatatttcattttaaaataatacttctttatctttatacatcctataaaataatttacttatatataaatatactgcttttatttattactctttaatacaaataaattaattttattttatgtagtaattttatcattcttcttcaagtgaataattgagatgcttaatattttattaattatgatcatatataacaaaaaggtacttagtataaatctaagtaccttgaattacatatcaacatttataagagtcatttttaatgctaaaattaatatctattttggtcaagccctcgacctattagtatcagtcagctacatacgttaccgcacttacacctctgacctatcaaccttgtgttcttcaaggggtcttactagcttatgctatgggaaatctcatcttgagggaggcttcacgcttagatgctttcagcgtttatcccttcccgacttagctacccagccatgctcctggcggaacaactggtgcaccagaggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctactacagccccaggatgcgacgagccgacatcgaggtgccaaacctccccgtcgatgtggactcttgggggagatcagcctgttatccccgaggtagcttttatccgttgagcgatggccctcccacgaggtaccaccggatcactaagcccgactttcgtccctgctcgacttgtatgtctcgcagtcaggctcccttctgcctttgcactctacgaacgatttccgaccgttctgagggaacctttgggcgcctccgttactttttaggaggcgaccgccccagtcaaactgcccacctaacaatgtccagtcaccagattcatggcgtcctgttagaaccccagtactgtcagggtggtatcccaaggttgactccactaaggctgacgccctagtttcccagtctcccacctatcctgtacagacaataccggaattcaatgctaagctacagtaaagctctacggggtctttccgtccaatcgcgggtagcgagcatcttcactcgcactacaacttcgccggatttgcagttgagacagtgcccaagtcattacgccattcgtgcgggtcagaacttacctgacaaggaatttcgctaccttaggaccgttatagttacggccgccgtttactggggcttaagttcacaccttcgcttgcgctaagtgttccccttaaccttccagcaccgggcaggcgtcagcccctatacatcagcttacgctttagcagagacctgtgtttttgctaaacagttgcttgggcctattctctgcggcctgctctcgcaggcaccccttctcgcgaacttacggggtcaatttgcctagttccttaactgcaattcttccgccggccttaggattctctcctcatctacctgtgtcggtttgcggtacgggcactacttctctctctagatgcttttcttggaagcatggaatcatgtacttcggcctatatggccttccccatcacgcctcagaattgttacagcggatttgcctaccgtaactccctaaacgcttagactagcatttccaatcgctagcacacactatccttctccgtcacaccctcgataataacgatggtagtggtatcggaatatcaaccgattgtccatcgcctacgcctttcggcctcggcttaggtcccgactaaccctcagcggacgagccttcctgaggaaaccttagatattcggcctgtaggattctcacctacatctcgctactaatgccaacattctcactcgtaatcagtccaccgctccttacggtacgacttcagcccgattacgacgctcccctaccacttgcaattgcttgcaaattcgtagcttcggtggtaagtttagccccggtacattttcggcgcaggatctctcgactagtgagctattacgcactctttaaatgagtggctgcttctaagccaacatcctagttgtcttagaaatcccacatccttttccacttaacttacactttgggaccttagctgacgatctgggctgtttcccttttgaccacggatcttatcattcgtagtctgactgccggactaaatgtatatggcattcggagtttgataaggttcggtaagcgatatgccccctagcccattcagtgctctacctccactacacatatccgacgctagccctaaagctatttcggggagaaccagctatctccgagttcgattggaatttctccgctatccacagctcatcccatgctttttcaacagcaacgtggttcggtcctccacgaagttttaccctcgcttcaacctggccatggataggtcacccggtttcgggtctacggcatgcaactagtcgccctattaagactcggtttcccttcggctccgtaccttaagtacttaaccttgctacataccgtaactcgttggctcgttctacaaaaagcacgtcatcaccctcataaggggctctgaccggttgtaggcacacggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggatcagagcttgataatcttaactttcacctacaggactattacctcctacggtccaactttccagttgtgttcggttagttacgacttctcgttaatgctctgtccgcaaccccaaagataaatctttggtttgggctctttccctttcgctcgccgctacttaggaaatcgatttttctttctcttcctctaggtacttagatgtttcagttccctaggtttaccctcgtatagctatgtattcactatacgatacatggggtttcccatgtgtgttcccacattcggaaatctccggatcactggctatgtgcgcctacccgaagcttatcgcagcttatcacgtccttcatcggctcctgatgccaaggcattcaccatgcgccctttgtagcttgacctgtatttccgctattgtctttgctaacataactttttgattttcaccaaatccaccaatattattatgatataaataaagtgtgacaaaactgtttgtttaatataattaataccaaacctacagttttgtcacactttgaataattaaatatttacttttcaatggtatcacttttcattatgtttatatattatatacaagtaccatgttttttgataccgctataaatttatgcaacttcttctaatatccaaactgtatgaagtttaccatccctttttattcttttactatcaattttataattaatattattatcttcaaaaaatgaattaatagtttttaaccctaatttcttacttccatcttttcgagttaaaccaaacttattagatattacattaataaatatttcttgttcatctttaaatatttttttatctttgtaactatctataatatctaatttaatatattcttctctttttagttgctccaagtcataccatgaaacaccaggaaaatatttttttaatactctattctcaaaaccatacgcccttatatcttggtataaatcaaactcatattctaatcttcctaaattagttgtatgtgttcttaatgttatcatttcttcaccagtaaaaggatttactatagtatctaaatataatgacttcatacttttatcaataatatctaatccatatttttttacaaaattaatttcacctaatcttacaaattcatcataataaaataattgcttttctaatcctcttaatttagcttctattgctcttggtgtaattctcttataaaatacatttactttattacttctaatccttgcagttgtttgaacaaacttttctaaatctgaaacaccattaataattatggtttctactgtactatcaaatatttctgtaccttcacaaattaaagaagttgtatttaatacatcactattaaatttttgatgctttactatacttttaaattcttttgaattatctttgttatttgatattaaattttcaacttgtccactaattgtatcttgccacatatctaactcatgctttttattatttattattaatacctttttacctttattaacttcttgctgaattatcggtgtaactgtatcttgactttcatatctataaaaatcttttacattattattgttataatctgcatcttttaagacttctaatttatttaaaaatggtaaataatctaaagcttcataagttgcggtcataaatatttttactatattatgattattatttaaccaatcaaaacttaaaacagttttattattcatacttgtatcttttataaaataatgtgcttcatcacatacaatataattaatttctcctaagctgcaccaacttaattttttatctttacttctaagtacattttcaaatttttgataactcattatttcaaaagtaccagctttaaaatttcttatacaaaattgttcgtactcttctaaataattatattgttgctctttaattgcagttcttgaacttaatattaaaactttcatgttattatcaaaagcatacggtaataaaatatttctaacccaataatttttaccgctgcccatctctgaacctattagataattatttcctttaattaattcttcaaccttttcttttcctattacatcactaacatattttcttttcatgccttttatcctccgttattcctctattttaattccatctaaagataataaatatcttacatattctgatactgatttataattatcttgctctgctttctctgttactgcttgtctttcttctggtgttaaaaatactcttaattccttatttctctttcttttcataatgtaaagtcctcctggttttttcttttgcttgatgccttatatttatattatttaataaaatttcttaaaagttcactttgaaaagtaaaataaaattatacttttatttcttacgatattatccatttttgacaacaaaaaaagcacctggaaattaatccagatgcaaaaaataaaaatatgtttatataaattattatctaattataaaatatagcaatgctaatgctcctataagtcttgttatcgaacaaaataatttaaaaatttcttttgttagctccattttttacctccccccttttttttacttaaattatatactatattttgataagtatacaagaaatataatgtcaactaataattacctaaccaaaataggaaggctttttaaaaccctcctattgccttaacttgctatctttaatttatttaatttactttggtaattccttattgtttgcggtgctaaattggtaattcttataatttcttcatttgtgtaaccttgttcttttaattctttgaatttatcaaaattacttactttactttttcttggtggctctggctcataatcacattcataattttctatattaactttttcattagataataatatcattcctagtaaatcactataaatacattcaatatcattcaatacttttatattatactctcttggaatactttgtttaaattcatttaatagcagcaatgcaccaccaccacaaaatactacatttgtattacctggatttgataacttaataactccattatatatatcattccataaccaacttcaaaagtagtttcaggataccatcctaattcatccttaatcttagttgggtcgattccgtatcttctatcgtgaccttttctatcttcaacatacttaattaagttttcagtaactgcttcatcaacattttcatttaagtaagctattacagtcttaactattgtaatattagttctttcattatgtccaccaacattataaacttctccaactctaccgttgtttataaccatatcgatagctttagcgtggtcttcaacaaataaccagtctcttatgttcattccatcaccgtaaactggtaaatctttatgagctaaacaattgttaattaataatggtattaacttttctgggaattggaatggtccatagttgtttgaacatcttgttatgttcattggcattttgtaagtatcatggtaagccttaaccattaaatctgatccagccttacttgctgagtatgggctatgaggatcaagtggtgtagtttccatgaagtaccctgtttcccctaatgaaccataaacttcgtcagttgaaacgtgtaagaacttaactccttctttccatgttccatcttctttttcccatgctgcttttgcacaatttaaaagatttactgttcccataacatttgtctttgcaaatacttctggttctcttatacttctatcaacgtgagattctgctgcaaagtgagcaacgtagtctatttcatatttttcgaataaagaattaactaattcattgtcacaaatatctccgtgtacaaatatgtgtcttggatcattttgaattgactttaaattttctaagtttcctgcataagttaacttatctaagtttattattcttatatcttcatatttatttaacatgtataatacaaagtttgagcctataaatccagctccaccagttactaaataagttttcataattaaattctccttattattaaaagcttaaatttgttaataattttattactataattaatgaatcaagttctatttaatttaatcttgaatcttaattatttttcaacattatccatgaaagtttttaaagcatccttccaatctctcatttcatcaccaatagtacatctaagcatcatattatcaagtgatgaataagctggtctatccgctgaattaggatacatactcttatattctgcagaagtgcaaggatttacagtgcaatttcttcctgaaagcttcattatttcagatgcaaaatcataccaactgcattctccctttcctgtacaatggtatactccatattcttctgtttcaataagttttaatatatgatatgctaaatcatttgcatgtgttggatttccaagttggtcatttacaacacttaatgtatctctatcttttccaagcttcatcattgtataaacaaagttatgtcctacatacccataaagccatgctgttctaactatataatattttgatgaaaaatctcttacgaactcttcacctaaaagcttagtttttccgtaaacacttacaggcgccactaaatcagattcctttaatggtgtttctcctactccactaaatacatagtcagttgaaacttgaactatttttgctcctaattcttcagctaccatagctaaatttctaggacctagtgaatttattttaaaagctaaatcttgatttgcttcacatccatcaacatttgttgctgcagcgcagtttataactacgtctggtttaatatcatttaaaactttcttaacttgttctaagtttgttatatctaatgtatctacatccatagcaaaaacttttgcatttttaatttcttctgaaactgctcctatttctgcttttcctgtagctactattttttgcagttcatttcctaattgtccatttgaaccagttattaatatcttcatcttactacctccattacgttaatttttttatttcaaattagcactctttatttttcgtaaacgaacggtaggtctaattccttaaatttcttttgcttcttatctttttctgataataatatttcttcgattccatctaatggccattctacagcaacatcttcatcgttccataaaagtccaccatcatgttctggtgaatagaaatctgtacatttatagttaaatgttgcagtttcagataatactacaaatccatgtgcaaaaccttctggtacatagaattgtctcttattttctgcacttaagtatacaccttcccattgtccgtatgttggtgacccttttcttaagtctacagcaacatcccaaacttcaccttcagtacatcttacaagctttccttgtgtatgttgtgtttggaagtgtaatcctcttaaaacaccttttttagatcttgattcattatcttgtacgaaagtcattgttaaacctgcttcatcaaaatgttgcttgttataactttccatgaaatatcctctagcatctccaaatacctttggttctacaatatataaatcaggtattttagtttctataaatttaaaatttcgtatttccgctattgtctttgctaacataactttttgattttcaccaaatccaccttcaataactggtatattaaaacctaaattattaaacatctaacccataaaaggctttcgccttttaatgggggtggttggaactcgttccaatccaccaatattattatgatataaataaagtgtgacaaaactgtttgtttaatataattaataccaaacctacagttttgtcacactttgaataattaaatatttacttttcaatgctccaaattcattatatttatatattatatacaaataccatgtttttggagcatatattattaacttaccttttctaatatccaaactgtatgaagtttagctgcgtttgcttcgctgcacttgctttaaatgctgtcgcatttagttagtttcttattaatataaattactcaaaacacttttaaaaatttatttttaaaacatgatgcttgataaagtatcatatatataggtaataaatttaactattggcttatttactagctttaagggcatttttagcggcacaaaaaaagtaataaaccttgaaaatcggcacaaaaaaagtaataaaccttgaaaatctatataaaaaaagagtagtaaaaaactacccttatacaccaatttcaaatattttggcaacatctgaaattttaccttcattagacttccaaaaaatagctggatttattactaatttagttatattaaaattatctttccattcagctatgacctttttatcatttattcttaacttaaataatttacttttcaaattatatgcttgtttcttttctaaccctattctttccgctaaatctgaccaacttaatggttttactaatttagcatctgtttcttctggattttcacataatatattaaattcactatttaagtaaggtaacactttaataaatgttgctaattgtttatgttgtcttggagtaacaccgttatataattcattaaatccacttataaacactcttgtcatattaccatcaccttttactttccctttaattgcatactctttattaacagtaattacaccttgtccatcaataaatattaatttattggctattaaatatttttttgtattccttaattctctttctgataaatcccaaactttatttaaatctctttctaatattttaattcttccttttgtttcaccttcaacaataatattttcataattcatgtaagtacataatttagcaaatcttataatataattatcatcaaattctttgtttaaaatatttttaaataataagtgatagaaataaccaccaatacttaacatagagttattttcattttttatcttaataaaattttcattaatctctttatcttctgtaaataactcatttgtaatatcacaaaccaaattatttaacacttctccatgtaattcaataacttctccatcacttgtaataatattagtattttgtataatcctttcaactgcatcagcttttttagtataacaacctttatttatcatatgttcctccataatataaaaaatttgtaacttttaaatagttacctactttacaacctggagaaaagttataaagttctttaacctcctttttataaaatatatatttatattatatataagcaatatttacaagttcactttcaaaagtaaaataaaattatagttttatttcttacgatactatccatttttgccaacaaaaaaagcacctggaattacccagatgcaaaaaataaaaatatgtttatacaaattattatctaattatgaaatatagtaacgctaatgctcctataagtcttgttatcgaacaaaataacttaaataactcttttgttagttccattttttaccttcaccccttttaacttaattatatactatattttgataagtatacaagaaatataatgtcaactaataattaaaggggctgtatcagattgaattaataaattcaatctgaatacaactcctttttaattgttcaaaattttatacactaatttttatgtaaatattgctattaattttgtttttttacatgacaaaaagaaggttagatgccttctggtataattttcatatatagtttttattatgcacctttcggctcgtgcaacaactcgccgtttcgaccttgtaaagttttgttgtgcaatttattaacattataggcaaatgccattatcaataattctattctaactttcttatttcccctcattaaaaatcttctaaatccataatcttgtttaattactgcaaatgcaccttcaacttgaatagatctatttattcttaaacgtaccccttctttggttgttatgttagctaatgattcagatcttaatcttaaaaattctttaggaacatataattgcctattattcttagcttttgtgcatttatttttatattcacaccctaaacagctttcgcattcgtagatatttactattgatttaaagtttgattttgattttcttgtagtagatcctttaggaagtagtttctttccagcagcacaaatatagtaatcatcctcttggttatattgcatattttctcttttactaatatcatttttaaactttttagtttttgatttttcatatgtttgaggcttaatgaaagctttttgattattattttctaaatatgtatagttttcttcactttcgtatcctgcgtcagcagttatagatttatattttttatttaagttcttttctaacttatctaaaaatggtataaaggtaagttgatctgatctttcacttgatatatctattccaactatatattcaccttctacccctatttgaacattatatgctggcttcaactgaccatttttcatatgatcctctttcatatgcatgaaagtagcgtcatgatcggtttttgaaaaactatttcttccattaaaaattttattgtattcatcatatttactttgtttttctataaaatcattaattacttcagtgtatttttgaagtttactttttcttttgccttttccatatacaaagtctaagcctcctttttctttaatttcaataagtttatcttttaccgctaatgcatattcaactgagatcttttcatcaggtatacttaaatttaaatcaagctctgaacttatgtttaataatattttatgagttttattttgtaatttctcttcaaatttatcagtagcttttttccaaataaaactatatctattagcattcgcttcgatttttgtaccatctacaaataaattttcaaattctatttcatttcgtttttctaattcaattataaattgtgaaaataaatcttctacacatccttctaacttttcacttataaatcttgcaattgtgttatggctcggttccttttgcccttgcaaaagccaacgaaagttaatatctcttttacaagctttttcaagttttctactagaatatataccttccatatagccataagtaactattctaaataatgtttcaggtaagagcattggatttctaccttcagtagagtatgcttcatataattttgaataatctagtccctccgttacttcatataatgttcttactgaatcatctttcggtataataatttctaaattaattgggaatcctaattgatggatgtgtataatattttttttgcatataatatttttcatgaaaatattatatgcaaaaaggaggattcgaattcgaaccctcctttttttatcggctattatcaaaatttattttgatacagccccgcatgaccagtatcaagtaacacaacattctcagcaaattccttcaaagcatattgttggcaaaccttagtactaagctttccataattaatatcctcagaaggtaccttcaaaacaacaacgcctgtcttatcaagttgctctcttatactatcagacaagctctccttagcaagcttacaagatccagaaaaagcaccaagttcatcatcatttctttcaccttgaatatcagctactccacatcttgcactaatgctaagtcttggtccaaatgctgggcaacgtaaaacacacatagagcatccattaccatatcttaaacaattccccattggtcctgttgtacctgttgtttcaataaatacatcacctttaacaaagcttccatcgcttagtaaaattccattaattctattattttcaaaatcaacatctgttacccttgtctccatatgaaggttaattcccttatctattaaataatctctaactacaccttcaattttatttacatcatacaaagttgcatgtttatgtcctggaaaatctatattagcatgtctagcacatttatctgttaacttaattaaatctcctccacctaatgcaattaactcttctgaagctgtataacgtccgttgtttctcattattccaccaacattaccaagtccaagtaaaagatctgttttttcataaatatggacttctgctccagcttttttagcactcaaagctgcggcacatccagaccagcctccaccaactattataaccttcatcatattaatctcctcccctcaaatatagctcttggactagcttgtaccttacagaatctctttactctatgtcctgaaaatcttgctgtgcacgctccacataccccttcaccacaacacatcttaaaattattacaacatgataaatcaatatcttgcctatctagagaatctaaatattcgatgacattataagttaatatatctgctccagcaatgtggattaaagatatattattatagccaattattgattttatagccaccttagcttcaggagatagcttacctttttcaattaaattcatttcttgaggaacaatatttagcttatctaaccattcagatacgtatacatcattaaacggttgcttatcaacaagtacagtaacattgttatcattttgaactagtttcttaattacaggtaccataggagccattccaatacctcttgcaattactaaaacctcattatttttttgttttcttatgttttttaaaccaaatacaccattccaataaggtcccctaatagttatttctcctccagattcaatatttaataattgtttagttttgacacctcttatttctatcattattgaaataatatttgtatcaatattagaatctaatattgaaataggcacatcaaaataaacattttcatcacttcttataaatataaagcttcctggctttgctaggtctattgctaatttatgtggtgcttcaaatttaattaaaagcacatcatcttgacatagcactttttcagatactttgcaggtataagcctttctttgctccttagctttattaccattattatgaagttcttgataaatacaaactccattccaatttaaacaatcacaaaaatgactaccttgtctttgaaaattgaacagaatatagttaaagtaaaccagcaattcttttgagagtcttaaaacaaagactcaaagtaatttgagcaacagattaaactttttagtgagagtttgatcctggctcaggacgaacgctggcggcgtgcctaacacatgcaagtcgagcgagtgaatctccttcgggagtgaagctagcggcggacgggtgagtaacacgtgggcaacctgcctcatagaggggaatagccttccgaaaggaagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatacccgggctcaacttgggtgctgcatttcaaactggaagtctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattacccttaatcggggaagttccttcgggaacaggaagacaggtggtgcatggttgtcgtcagctcgtgtcgtgagatgttgggttaagtcccgcaacgagcgcaacccctattgttagttgctaccattaagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctgactcgcaagagaggaagcgccctaaggtagggtcagcgattggggtgaagtcgtaacaaggtagccgtaggagaacctgcggctggatcacctcctttctatggagaaatgaaacaacaagatgtttgtttcgtaaatgcaccaaacccagtggagtcccgagaggcccctcccacctccagtttccctggcttctcagagccaccatgagaagccccctgaggtcacctgcacaagtcgagggaacccagggtttcctgcctcaacccgggaaagacctcgagagaccttcttcaacacgtctcgaggccagattcccctaccatgactcgggagcaatgacgcgctccccctcgccactcgcatggagacccgacttccctggcgccccacgagaggctcactgacctcgccgtcgtacctcgtgagaaaccgcacactggggccgccgctcgagaacaaccccgagattcccccgtcatcgagagatgagggccttcgtctcctgcatggcctagagaccaatctcgcgacctctctccaaacgcctcaggaggcttgactcccttgagtccacccagtgagctccaagagatacccgtcgcgactcgagagcagagcggggttctttgcttccactcgagatggatgcctgtctccccgggtgcgtctggaatgcaaccccgagatccctgtcgcccctggagaggaacattggcttctggacacaagcctagatgaggtctattggccctgcagtcactcgagagcaatccccagctttccttcgcaactcgaatggaagattggacttgcctgggccaacacaagaggcagcctgaattccccgtcgtaactcgagaatcccgccgtaactcgagaaaaaccacgtggctcccccgtcatcgcaagatgaagccctttcccgctacagcgcctcaggagaagtcccacgttaggaattggaggtcgaaagggcacttggcacccttgatgcgacccacaaagttccccgaaatcccggtctccctcgagaggaacactgaggttttccggcaccccctcctctgagccctttctcccctcctgatctggacgggagggtcgactcccctgctttgtctggaaggggttcccgaccttccggtcgcacctcaggatgaggccggtctcacgaagacattccagacgtggcctcgtgggtggttccacattccgtaggaccccgatttcccggtcccctcttgataagaacccgatgcccggacacctctccgaactccagcctgtgaatgaagtcaacacgaaggggcagtttttccgtgcatcgttcggaaaaaaccccaggttccaaatacagctcgacaagcggcctctctccccggggacatctcgagaggcaagcggagttccatgcctcaacccaagacgaggcctgactctcctgtccccagtctgcagggaccctgcgatcggagtctgaaatcagaggtaccctgcggttcctgcctcaactggagatgaggccctcttccaatgcaccaaacccagtggagtcccgagaggcccctcccacctccagtttccctgcaacaattaccgcgtctggacatagattgtccgagatttttagactttaataatttttgaaatcttggacttgtgtaatgagctccttggtctgagtgaataaatgcatccttatgtaatttaaattttgtattattcatcagtttatgaatagtatcaatagcaatatcaagtgttatattatttgataaattatgcgctaatatttcattagtagaagcatctttgatggtcgacaaataggccatctgattattaccatatggcagataggttatatccgtaagaagtacttttccagctacttcttgtttgaaatttctatttagaagatttggaacaactctatgttctttagttgctttagccattcttctgtacggattagcttttcttattggacaaacaatattatattttctcataatcctttgaatacgctttctgttataagttattccaaactcattttccaatagcatttttattgatctagaacccttcttataccctttatagttaaaagcttttaatatattatctctaacacttaaatcaatattcgcttgcttgatttttatagacttattatttaaaaatctgtaatatccggagcgtgaaacaccagctatagaacataaatggctaactaaggaattgaattttgaattcttagttattctttcaattaaagtaaatgcttttgctgcaactagtttaccttttctcacctgcctttcgtgcagctctaatttttttaaaagttcaacctcagcttttaaatattcaatttcagcgttttgctttgctattaactcatctttagtaagttcacgctgacgcggacgtccactattttttctccttgtgtcatctaatccaagaactccattttctttatatgccgttctccacctactagatgcacatttaatgcgttttaatccaataatattaatatcgaagcctgcttcttcaaaaatatctctaggtaattttttattattatattctgcaataaaatgaattttaaattcatttgtataagttatagacttttcacttacatttttaacatatttattttttgataaaatttctatatcttgctctgaaaaagtttttttgctcactctttgatcacctcattaatttattgtacaaaaaaagactctatatagatagatactctttttttgagtgtctactatatagggtccattttaggtttagaagaaatttataattcattagaaaataaattgttaggttgggataaactagaagaagttgaaaaagaaacaacagaaagtaatgatatattaagttcaatacttgcgaaagcaatataaaaaaaggcataccaaaaggtacaccaaaccacaatttgattatatcatttggtatgctccaagtaaaggagattttaaaaatgagtatatatgtattaattgaatatataaatgaagtaggaaaagaaaatgcaacatttgaaggattaaaagaatggaaagaaaaaaactggagggagtaattaaaatgaaacatttaagaagaattaaaaataaaattgaagatattataagaaaatttaaatatagaaaaattaagaaatttaataatagtaatgaaactgtgtttgtagatttaggggcatcaagtattaaaatgagttacaagggcgaattaataacctttagaagcagcataagaaaagtatatgataataatgaaattacaatacagaaaaactctattaatgtaaatggtcaatggtttatagtcggggaaagtacacaaccaactggaaattatgaatataagtatgagaaagaacatttagaaatattaatattattcgggttaagtatgattaaagataaagtaaaaagtataagtaatgatttaaaagtaaatatacttttaccatataatcaaatacatactaaaaagcagctaagtaataaaatagatgggatatatcaattaagaaataatttacatgaatttgatttagcattaactttaaataaagtatttgttgaaggtgaaacaagtaaagtatactttgaaaagaattataatactggcggtaatacttgtgtagttaatattggttatagtacaactgatattgcattatataatactttaaattgtagggagcaaataacaagtattaatataggcacaaataatttattatctcaatacttaaagtataccaaagcaccaacaagcagcgttttaaatacctggttaaatgatgggtataccttcacaaaagaagagtataagaatataagtatggttaatcaagagtatattaaaactttatggaatgatatatataatggagttattaagttatcaaatccaggtaatacaataagtgcggtaacgtatgtagctgactgatactaataggtcgagggcttgaccaataaaaatataattcatgtgcaattttgagataacaatctcaataatctggtgatgatggcgtagaggaaacactccttcccattccgaacaggaaagttaagctctacagcgtcgatggtactgcacgggtgactgtgtgggagagtagaacgttgccaggtaatataaggtacttagtataaaagctaagtgccttttttgttatattaaaatatagttaaatggtgaagagtaaaattataccttgcacggctagtagaaaaagataggttatgtcttttcgaagatcaatgaaagtgttaaaaattgacctgataaacgttgtcaggtaagaagatacttagtttatactaggtatcttttttgttatttaatattaataataaaaaaagcaacgttataatcgtccactgacaaatagagaaagtatattatgtttttatcagttgatttatccaagattaatagaagtgtaaagaaacaccatgataaacgttgctaggtaatgtaaggtacttagtataaaagccaagtagcttttttgttatattaaaatatagtttaaatgttaaatagtaacgttctaatattcagcatgaagaagataagagcaaggtatgattttgcttggttatttagaggtgattaattaaaacacaagaaagggtcttggtaaaagatatactatgatttttcattaaaaattagtgaagcttaatctaatggtcaaaaattacttcaacgaaaattactatatggataagaagagatttggtttatattaaatatttttttattatcaaataatattaaaagaaaaaaatgttctagttatttgttagatacagtaagactcggataaaattttaagggaggattagagtaaagtaattgaattattaaaaggtaatttgatagagataatatgttttttatatataaattattttagtgttaaaaaatataataataatttttaataaataaaagaatatatctaattttaaagtggaccctatgtcaaggacattaaaaaaaggggctaagccactaaaagctgatttctgtattttacaggagtcagcttgtctcttaccagcttaactacagttgatcggacgggaaacggtgctttctggtagatatggccgcaaccgatagtttaacggaaacgcaggtgatatgagggcagggtccagacatgttcagtaggtgggagtgagaggtgttatgggtggaggacaatttttattatatttcatctaatagcaataggatatgagaggtgaaaaagcaaaagcaatagtgcattgtgatgtggagaataaggtgcatacgatgaaaaaggtgatttgtcatttacaagaggtaggtcgaaacagaacatgaaagttggtcggtaggtggcatgcagaggtagtttcaaggtgacaggttatgaagatatggtgcaaaagacaaatggatggtggcaggcatagtaaaatgatggtgtggaagacatagatggtatttgttttgcatttacggcaccggatgcgggcgataatgacgggaagagatttagtatgtgggacagaatttcggcggcagtattgagaccatgagagtagcaaacgtaagtctaaaggttgttttatagtagttaggatgtaggaaatgtattccgataggccattttacatttggagggacggttgaaagtggacagaggaaaaggtgcggaaatggctgattttgattgtttatgttttgtgtgataattttacatttttgcatagtattaggtagtcagatgaaagatgaatagacataggagtaagaaaacatagaatagttaccattattggtaggagtgtggtggggtggtatagtccgcattgggatgttactttcctgttatggcatggatttccctttagggtctctgaagcgtatttccgtcaccgaaaaaggcagaaaaagggaaactgaagggaggatagtagtaaagtttgaatggtggtagtgtaatgtatgatatccgttggttttggtttcggttgtgaaaagttttttggtatgatattttgcaagtagcatatatttcttgtgtgagaaaggtatattttgtatgttcccgcgcgtttccgtattttccgcttccgtattttccgcttccgtattttccgcttccgtatttactctcaaaagaattgctggtttactttaactatattctgttcaattttcaaagaccatttactctgtcgcaccgaagcgacttctttatcttatcatcatcaaaactttttgtcaacactttttttgaaaactttttttcttttctttaaatgttgcttgctgtcctgacgacttccttataatatcattattaaattcttatgtcaacatattttttaaaatttattgtatattatttaaaattccctattttctccttatatatcttatattatctacaatttatataataaatattccttaaattctaaaaatattattatctaaatctaatattattaataaaattttaaagttataaagaaaaataattttgtaatatacccttcattaaataacttaactttctattcatccaatattgctattatatttttttaaaaattaattcaagaatttaaaaattattatataaatttatttatataataaaaaacaccagcttagctagtgctttttttcttaaatcccataaaatccattattagttgacagcttaaggtgaatagttggatcaatcagctacttttcatcttaattactcctcttaaaaaggcacgtatattctttaagcgtaatttaattatttatcatttgtttaaaattattaagaaatttttttgtatactaatcatttaagctattcttaaatatatttttcatagtaggtaatattttttttatataacaaaaaaagctacgacattaatcgtagcttttggtggaggtaaagggattcgaacccttgaccccttgcgtgcaaggcaagtgctctcccaactgagctatacccccaaatttacctggcaacgttctactctcccacacagtcacccgtgcagtaccatcgacgctgtagagcttaactttcctgttcggaatgggaaggagtgtttcctctacgccatcatcaccagattattgagattgttatctcaaaattgcacatgaattatatttttattggtcaagccctcgacctattagtatcagtcagctacatacgttaccgcactta
